(12) United States Patent
Sullivan et al.

(10) Patent No.: US 7,833,979 B2
(45) Date of Patent: Nov. 16, 2010

(54) TOXIN PEPTIDE THERAPEUTIC AGENTS

(75) Inventors: John K. Sullivan, Newbury Park, CA (US); Joseph G. McGivern, Oak Park, CA (US); Leslie P. Miranda, Thousand Oaks, CA (US); Hung Q. Nguyen, Thousand Oaks, CA (US); Kenneth W. Walker, Newbury Park, CA (US); Shaw-Fen Sylvia Hu, Thousand Oaks, CA (US); Colin V. Gegg, Newbury Park, CA (US); Stefan I. McDonough, Cambridge, MA (US)

(73) Assignee: Amgen Inc., Thousand Oaks, CA (US)

( * ) Notice: Subject to any disclaimer, the term of this patent is extended or adjusted under 35 U.S.C. 154(b) by 536 days.

(21) Appl. No.: 11/406,454

(22) Filed: Apr. 17, 2006

(65) Prior Publication Data

US 2007/0071764 A1 Mar. 29, 2007

Related U.S. Application Data

(60) Provisional application No. 60/674,342, filed on Apr. 22, 2005.

(51) Int. Cl.
*A61K 38/00* (2006.01)
*C07K 14/00* (2006.01)

(52) U.S. Cl. .......................................... 514/12; 530/300
(58) Field of Classification Search ........................ None
See application file for complete search history.

(56) References Cited

U.S. PATENT DOCUMENTS

| | | | |
|---|---|---|---|
| 4,847,325 A | 7/1989 | Shadle et al. |
| 4,906,159 A | 3/1990 | Sabo et al. |
| 4,911,916 A | 3/1990 | Cleary et al. |
| 4,925,677 A | 5/1990 | Shah et al. |
| 4,994,439 A | 2/1991 | Longenecker et al. |
| 5,023,084 A | 6/1991 | Chien et al. |
| 5,166,322 A | 11/1992 | Shaw et al. |
| 5,171,264 A | 12/1992 | Merrill et al. |
| 5,206,344 A | 4/1993 | Katre et al. |
| 5,252,714 A | 10/1993 | Harris et al. |
| 5,284,656 A | 2/1994 | Platz et al. |
| 5,346,701 A | 9/1994 | Heiber et al. |
| 5,397,702 A | 3/1995 | Cahalan et al. |
| 5,446,090 A | 8/1995 | Harris et al. |
| 5,460,820 A | 10/1995 | Ebert et al. |
| 5,494,895 A | 2/1996 | Garcia et al. |
| 5,516,523 A | 5/1996 | Heiber et al. |
| 5,605,702 A | 2/1997 | Teillaud et al. |
| 5,643,575 A | 7/1997 | Martinez et al. |
| 5,714,142 A | 2/1998 | Blaney et al. |
| 5,739,208 A | 4/1998 | Harris et al. |
| 5,739,277 A | 4/1998 | Presta et al. |
| 5,763,478 A | 6/1998 | Baker et al. |
| 5,783,208 A | 7/1998 | Venkateshwaran et al. |
| 5,792,451 A | 8/1998 | Sarubbi et al. |
| 5,827,655 A | 10/1998 | Chandy et al. |
| 5,900,461 A | 5/1999 | Harris et al. |
| 5,919,455 A | 7/1999 | Greenwald et al. |
| 5,932,462 A | 8/1999 | Harris et al. |
| 5,990,237 A | 11/1999 | Bentley et al. |
| 6,077,680 A | 6/2000 | Kem et al. |
| 6,096,891 A | 8/2000 | Carr et al. |
| 6,245,740 B1 | 6/2001 | Goldenberg et al. |
| 6,267,964 B1 | 7/2001 | Nygren et al. |
| 6,273,086 B1 | 8/2001 | Ohki et al. |
| 6,342,225 B1 | 1/2002 | Jones et al. |
| 6,451,986 B1 | 9/2002 | Pettit |
| 6,548,644 B1 | 4/2003 | Pettit |
| 6,551,821 B1 | 4/2003 | Kandel et al. |
| 6,552,170 B1 | 4/2003 | Thompson et al. |
| 6,602,498 B2 | 8/2003 | Shen |

(Continued)

FOREIGN PATENT DOCUMENTS

EP 0 219 716 A2 4/1987

(Continued)

OTHER PUBLICATIONS

Brantly, M., "Alpha1-Antitrypsin: Not Just an Antiprotease", Am. J. Respir. Cell Mol. Biol. 27: 652-654 (2002).*

(Continued)

*Primary Examiner*—Anand U Desai
(74) *Attorney, Agent, or Firm*—Nisan A. Steinberg

(57) ABSTRACT

Disclosed is a composition of matter of the formula $$(X^1)_a\text{—}(F^1)_d\text{—}(X^2)_b\text{—}(F^2)_e\text{—}(X^3)_c \qquad (I)$$

and multimers thereof, in which $F^1$ and $F^2$ are half-life extending moieties, and d and e are each independently 0 or 1, provided that at least one of d and e is 1; $X^1$, $X^2$, and $X^3$ are each independently -(L)$_f$-P-(L)$_g$-, and f and g are each independently 0 or 1; P is a toxin peptide of no more than about 80 amino acid residues in length, comprising at least two intrapeptide disulfide bonds; L is an optional linker; and a, b, and c are each independently 0 or 1, provided that at least one of a, b and c is 1. Linkage to the half-life extending moiety or moieties increases the in vivo half-life of the toxin peptide, which otherwise would be quickly degraded. A pharmaceutical composition comprises the composition and a pharmaceutically acceptable carrier. Also disclosed are a DNA encoding the inventive composition of matter, an expression vector comprising the DNA, and a host cell comprising the expression vector. Methods of treating an autoimmune disorder, such as, but not limited to, multiple sclerosis, type 1 diabetes, psoriasis, inflammatory bowel disease, contact-mediated dermatitis, rheumatoid arthritis, psoriatic arthritis, asthma, allergy, restinosis, systemic sclerosis, fibrosis, scleroderma, glomerulonephritis, Sjogren syndrome, inflammatory bone resorption, transplant rejection, graft-versus-host disease, and lupus and of preventing or mitigating a relapse of a symptom of multiple sclerosis are also disclosed.

31 Claims, 115 Drawing Sheets

U.S. PATENT DOCUMENTS

| | | |
|---|---|---|
| 6,610,281 B2 | 8/2003 | Harris |
| 6,660,843 B1 | 12/2003 | Feige et al. |
| 6,689,749 B1 | 2/2004 | Lebrun et al. |
| 6,703,485 B2 | 3/2004 | Kandel et al. |
| 6,740,743 B2 | 5/2004 | Herrmann et al. |
| 6,768,002 B1 | 7/2004 | Herrmann et al. |
| 6,818,418 B1 | 11/2004 | Lipovsek et al. |
| 6,849,714 B1 | 2/2005 | Bridon et al. |
| 6,861,405 B2 | 3/2005 | Desir et al. |
| 6,887,470 B1 | 5/2005 | Bridon et al. |
| 6,892,728 B2 | 5/2005 | Helgesson et al. |
| 6,894,025 B2 | 5/2005 | Harris |
| 6,900,317 B2 | 5/2005 | Trunk et al. |
| 6,905,688 B2 | 6/2005 | Rosen et al. |
| 6,926,898 B2 | 8/2005 | Rosen et al. |
| 6,932,962 B1 | 8/2005 | Bäckstrom et al. |
| 6,946,134 B1 | 9/2005 | Rosen et al. |
| 6,989,365 B2 | 1/2006 | Fleer et al. |
| 7,005,436 B2 | 2/2006 | Lloyd et al. |
| 7,348,004 B2 | 3/2008 | Peters et al. |
| 7,381,408 B2 | 6/2008 | Mezo et al. |
| 7,404,956 B2 | 7/2008 | Peters et al. |
| 2003/0069170 A1 | 4/2003 | Soltero et al. |
| 2003/0069395 A1 | 4/2003 | Sato et al. |
| 2004/0121959 A1 | 6/2004 | Boone et al. |
| 2005/0054570 A1 | 3/2005 | Rosen et al. |

FOREIGN PATENT DOCUMENTS

| | | |
|---|---|---|
| EP | 0 473 084 A2 | 8/1991 |
| EP | 0 668 353 A1 | 8/1995 |
| EP | 0 668 354 A1 | 8/1995 |
| EP | 0 575 545 B1 | 5/2003 |
| WO | WO 88/06451 | 9/1988 |
| WO | WO 92/02634 | 2/1992 |
| WO | 9503065 A1 | 2/1995 |
| WO | WO 95/13312 | 5/1995 |
| WO | WO 96/05309 | 2/1996 |
| WO | WO 96/11953 | 4/1996 |
| WO | WO 96/32478 | 10/1996 |
| WO | WO 97/34631 | 9/1997 |
| WO | WO 98/23639 A2 | 6/1998 |
| WO | WO 99/24055 | 5/1999 |
| WO | WO 99/38008 A1 | 7/1999 |
| WO | WO 00/38651 A1 | 7/2000 |
| WO | WO 00/69900 A2 | 11/2000 |
| WO | WO 01/83525 A2 | 11/2001 |
| WO | WO 02/11801 A2 | 2/2002 |
| WO | WO 02/098446 A1 * | 12/2002 |
| WO | WO 02/100248 A2 | 12/2002 |
| WO | WO 2004/017918 A2 | 3/2004 |
| WO | WO 2004/017918 A3 | 3/2004 |
| WO | WO 2004/043396 A2 | 5/2004 |
| WO | WO 2004/110472 A2 | 12/2004 |
| WO | WO 2005/047337 A1 | 5/2005 |
| WO | WO 2006/002850 A2 | 1/2006 |
| WO | 2006036834 A2 | 4/2006 |
| WO | WO 2006/042151 A2 | 4/2006 |

OTHER PUBLICATIONS

Norton et al., "Potassium Channel Blockade by the Sea Anemone Toxin ShK for the Treatment of Multiple Sclerosis and Other Autoimmune Diseases", Current Medicinal Chemistry 11: 3041-3052 (2004).*

Caliceti, et al. 'Pharmacokinetic and biodistribution properties of poly(ethylene glycol)-protein conjugates,' Adv. Drug Del. Rev., 55: 1261-1277 (2003).

Norton, et al. 'Potassium Channel Blockade by the Sea Anemone Toxin ShK for the Treatment of Multiple Sclerosis and Other Autoimmune Diseases,' Curr. Medic. Chem., 11: 3141-3152 (2004).

Wang, et al. 'Polyethylene Glycol-modified Chimeric Toxin Composed of Transforming Growth Factor α and *Pseudomonas* Exotoxin,' Cancer Research, 53: 4588-4594 (1993).

Bednarek et al., "Chemical synthesis and structure-function studies of margatoxin, a poten inhibitor of voltage-dependent potassium channel in human T lymphocytes", Biochemical and Biophysical Research Communications, 198(2): 619-625, (1994).

Judge et al., "Potassium channel blockers in multiple sclerosis: Neuronal Kv channels and effects of symptomatic treatment", Pharmacology and Therapeutics, Elsevier, GB, 111(1): 224-259, (2006).

Legros, et al., "Influence of a NH2-terminal extension on the activity of KTX2, a K<+> channel blocker purified from *Androctonus australis* scorpion venom", FEBS Letters, Elsevier, Amsterdam, NL, 417(1): 123-129, (1997).

Tytgat, J. et al., "A unified nomenclature for short-chain peptides isolated from scorpion venoms: alpha-KTx molecular subfamilies", Trends in Pharmacological Sciences, Elsevier, Haywarth, GB, 20(11): 444-447, (1999).

Beeton et al., "Selective blockade of T lymphocyte K+ channels ameliorates experimental autoimmune encephalomyelitis, a model for multiple sclerosis", PNAS, 98(24): 13942-13947 (2001).

Beeton et al., "The D-Diastereomer of ShK toxin selectively blocks voltage-gated k+ channels and inhibits T lymphocyte proliferation", J of Biological Chemistry, 283(2): 988-997 (2008).

Brown, Larry, "Commercial challenges of protein drug delivery", Expert Opin. Drug Deliv., 2(1): 29-42 (2005).

Abuchowski and Davis, "Soluble Polymer-Enzyme Adducts", *Enzymes as Drugs*, pp. 362-383 (1981).

Adams, et al., "Conotoxins and their Potential Pharmaceutical Applications", Drug Devel. Research, 46: 219-234 (1999).

Adjei & Garren, Pulmonary Delivery of Peptide Drugs: Effect of Particle Size on Bioavailability of Leuprolide Acetate in Healthy Male Volunteers, Pharma. Res. 7: 556-569 (1990).

Adjei, et al., "Bioavailability of Leuprolide Following Intratracheal Administration to Beagle Dogs", Internatl. J. Pharmaceutics, 63: 135-144 (1990).

Alberts, et al., "Synthesis of a Novel Hematopoietic Peptide SK&F 107647", Thirteenth Am. Pep. Symp., 367-369 (1993).

Altschul, et al, "Gapped BLAST and PSI-BLAST: A New Generation of Protein Database Search Programs", Nuc. Acids Res. 25 3389-3402 (1997).

Barrett, A., et al., Ed., Handbook of Proteolytic Enzymes, *Academic Press* (1998) (Table of Contents Provided Only).

Beeton, et al., "Targeting Effector Memory T Cells with a Selective Peptide Inhibitor of Kv1.3 Channels for Therapy of Autoimmune Diseases", Mol. Pharmacol. 67: 1369-1381 (2005).

Beeton, et al., "Kv1.3 Channels are a Therapeutic Target for T Cell-Mediated Autoimmune Diseases", PNAS 103(46): 17414-17419 (2006).

Berridge, et al., "Calcium Signalling: Dynamics, Homeostasis and Remodelling", Nature Reviews Mol. Cell Biol. 4: 517-529 (2003).

Bhatnagar, et al., "Structure-Activity Relationships of Novel Hematoregulatory Peptides", J. Med. Chem. 39: 3814-3819 (1996).

Bissonnette, et al., "A Randomized, Multicenter, Double-Blind, Placebo-Controlled Phase 2 Trial of ISA247 in Patients with Chronic Plaque Psoriasis", J. Am Acad. Dermatol 54(3): 472-478 (2006).

Boehm, et al., "Cellular Response to Interferon-γ", Annu. Rev. Immunul. 15: 749-795 (1997).

Bong, et al., "Chemoselective Pd(0)-Catalyzed Peptide Coupling in Water", Org. Lett. 3(6): 2509-2511 (2001).

Bourinet, et al., "Silencing of the $Ca_v3.2$ T-type Calcium Channel Gene in Sensory Neurons Demonstrates its Major Role in Nociception", EMBO J. 24(2): 315-324 (2004).

Bowlby, et al., "Modulation of the Kv1.3 Potassium Channel by Receptor Tyrosine Kinases", J. Gen. Physiol. 110: 601-610 (1997).

Braquet, et al., "Effect of Endothelin-1 on Blood Pressure and Bronchopulmonary System of the Guinea Pig", J. Cardio. Pharmacol. 13: 5143-5146 (1989).

Castle, et al., "Maurotoxin: A Potent Inhibitor of Intermediate Conductance $Ca^{2+}$-Activated Potassium Channels", Mol. Pharmacol. 63(2): 409-418 (2003).

Catterall, et al., "International Union of Pharmacology: Approaches to the Nomenclature of Voltage-Gated Ion Channels", Pharmacol. Rev. 55: 573-574 (2003).

Catterall, et al., "International Union of Pharmacology. XXXIX. Compendium of Voltage-Gated Ion Channels: Sodium Channels", *Pharmacol. Rev.* 55: 575-578 (2003).

Catterall, et al., "International Union of Pharmacology, XL. Compendium of Voltage-Gated Ion Channels: Calcium Channels", Pharmacol. Rev. 55: 579-581 (2003).

Chan, W. C. and White, P. D., Eds., Fmoc Solid Phase Peptide Synthesis: a Practical Approach, *Oxford University Press*, (Table of Contents Provided Only), (2000).

Chandy, et al., "K+ Channels as Targets for Specific Immunomodulation", *TIPS Pharmacol. Sciences* 25(5): 280-289 (2004).

Chen, et al., "MMDB: Entrez's 3D-Structure Database", *Nucleic Acids Res.* 31, 474-477 (2003).

Clapham, et al., "International Union of Pharmacology. ILIII. Compendium of Voltage-Gated Ion Channels: Transient Receptor Potential Channels", *Pharmacol. Rev.* 55: 591-596 (2003).

Connelly et al., "Neutral Endopeptidase 24.11 in Human Neutrophils: Cleavage of Chemotactic Peptide", *Proc. Natl. Acad. Sci USA* 82: 8737-8741 (1985).

Creighton, "Proteins: Structures and Molecular Principles", (W. H. Freeman & Co., San Francisco) pp. 70-86 (1983).

Davis, et al., "Preparation and Characterization of Antibodies with Specificity for the Amino-Terminal Tetrapeptide Sequence of the Platelet-Derived Connective Tissue", *Biochem Intl.* 10: 395-404 (1985).

Debs, et al., "Lung-Specific Delivery of Cytokines Induces Sustained Pulmonary and Systemic Immunomodulation in Rats", *J. Immunol.* 140: 3482-2488 (1988).

Dedman, et al., Selection of Targeted Biological Modifiers from a Bacteriophage Library of Random Peptides', *J. Biol. Chem.* 268(31): 23025-23030 (1993).

del Rio-Portilla, et al., "NMR Solution Structure of Cn12, a Novel Peptide from the Mexican Scorpion *Centruroides noxius* with a Typical β-Toxin Sequence but with α-Like Physiological Activity", *Eur. J. Biochem* 271: 2504-2516 (2004).

DeVasher, et al., "Aqueous-Phase, Palladium-Catalyzed Cross-Coupling of Aryl Bromides Under Mild Conditions, Using Water-Soluble, Sterically Demanding Alkylphosphines", *J. Org. Chem.* 69: 7919-7927 (2004).

Dibowski, H. and Schmidtchen, P., "Bioconjunction of Peptides by Palladium Catalyzed C-C Cross-Coupling in Water", *Angew. Chem. Int. Ed.* 37(4): 476-478 (1998).

Dogrul, et al., "Reversal of Experimental Neuropathic Pain by T-Type Calcium Channel Blockers" *Pain* 105: 159-168 (2003).

Duffy, et al., The K+ Channel $iK_{CA}1$ Potentiates $Ca^{2+}$ Influx and Degranulation in Human Lung Mast Cells; *J. Allergy Clin. Immunol.* 114: 66-72 (2004).

Earnshaw; et al., "Mammalian Caspases: Structure, Activation, Substrates, and Functions During Apoptosis", *Annu. Rev. Biochem* 68: 383-424 (1999).

Engel, et al., "Insertion of Carrier Proteins into Hydrophilic Loops of the *Escherichia coli* Lactose Permease", *Biochimica et Biophysica Acta* 1564: 38-46 (2002).

Ertel, et al., "Nomenclature of Voltage-Gated Calcium Channels", *Neuron* 25: 533-535 (2000).

Felix, A.M., "Pegylated Peptides IV: Enhanced Biological Activity of Site-Directed Pegylated GRF Analogs", *Int. J. Peptide Protein Res.* 46: 253-264 (1995).

Feske, et al., "A Severe Defect in CRAC $Ca^+$ Channel Activiatino and altered K+ Channel Gating in T Cells from Immunodeficient Patients", *J. Exp. Med.* 202: 651-662 (2005).

Finn, et al., *The Proteins*, "The Synthesis of Peptides by Solution Methods with Emphasis on Peptide Hormones", ($3^{rd}$ ed.), vol. II, pp. 105-253 (1976).

Flatters, S. and Bennett, G., "Ethosuximide Reverses Paclitaxel- and Vincristine-Induced Painful Peripheral Neuropathy", *Pain* 109: 150-161 (2004).

Gaffen, Sarah L. and Liu, Kathleen D., "Overview of Interleukin-2 Function, Production and Clinical Applications", *Cytokine* 28; 109-123 (2004).

Gennaro, A. R., Remington's Pharmaceutical Sciences, $18^{th}$ Ed, Mack Publishing Co., Easton, PA, Part 8: 1435-1712 (1990).

Glazebrook, et al., "Potassium Channels Kv1.1, Kv1.2 and Kv1.6 Influence Excitablity of Rat Visceral Sensory Neurons", *J. Physiology* 541: 467-482 (2002).

Goldin, et al, "Nomenclature of Voltage-Gated Sodium Channels", *Neuron* 28: 265-368 (2000).

González-Pinto, et al., "Five-Year Follow-Up of a Trial Comparing Tacrolimus and Cyclosporine Microemulsion in Liver Transplantation", *Transplan. Proc.* 37: 1713-1715 (2005).

Goodson, R. J. and Katre, N. V., "Site-Directed Pegylation of Recombinant Interleukin-2 at its Glycosylation Site", *Biotechnology* 8: 344-346 (1990).

Greene, et al., Protective Groups in Organic Synthesis, $3^{rd}$. Ed., *John Wiley & Sons, Inc.* (1999). (Table of Contents Provided Only).

Greenwald, et al., "Poly(ethylene glycol) Conjugated Drugs and Prodrugs: A Comprehensive Review", *Crit. Rev. in Thererap. Drug Carrier Systems*, 17(2): 101-161 (2000).

Grgic, et al., "Selective Blockade of the Intermediate-Conductance $Ca^{2+}$-Activated K+ Channel Suppresses Proliferation of Microvascular and Macrovascular Endothelial Cells and Angiogenesis in Vivo", *Arterioscler Thromb. Vase. Biol.* 25: 704-709 (2005).

Gutman, et al., "International Union of Pharmacology. XLI. Compendium of Voltage-Gated Ion Channels: Potassium Channels", *Pharmacol. Rev.* 55: 483-586 (2003).

Halaby, et al., "The Immunoglobin Fold Family: Sequence Analysis and 3D Structure Comparisons", *Prot. Engin.* 12(7): 563-571 (1999).

Harte, R. and Ouzounis, C. A., "Genome-Wide Detection and Family Clustering of Ion Channels", *FEBS Letters* 514 129-134 (2002).

Hendrickson, et al., "Incorporation of Nonnatural Amino Acids into Proteins", *Annu. Rev. Biochem.* 73: 147-176 (2004).

Herman, et al., Poly(Ethylene Glycol) with Reactive Endgroups: I. Modification of Proteins, *J. Bioactive and Comp. Plymers*, 10(2): 145-187 (1995).

Hofmann, et al., "International Union of Pharmacology. XLII. Compendium of Voltage-Gated Ion Channels: Cyclic Nucleotide-Modulated Channels", *Pharmacol. Rev.* 55: 587-589 (2003).

Hubbard, et al., "Anti-Neutrophil-Elastase Defenses of the Lower Respiratory Tract in α1-Antitrypsin Deficiency Directly Augmented with an Aerosol of α1-Antitrypsin", *Annals of Internal Med.* 111(3): 206-212 (1989).

IUPAC-IUB Joint Commission on Biochemical Nomenclature (JCBN), "Nomenclature and Symbolism for Amino Acids and Peptides", *Eur J. Biochem.* 138, 596-624 (1984).

Jäger, et al., "Blockage of Intermediate-Conductance $Ca^{2+}$-Activated K+ Channels Inhibit Human Pancreatic Cancer Cell Growth in Vitro", *Mol. Pharmacol.* 65: 630-638 (2004).

Jaravine, et al., "Three-Dimenstional Structure of Toxin OSK1 from *Orthochirus scrobiculosus*", Biochemistry 36: 1223-1232 (1997).

Jensen, et al., "The $Ca^{2+}$-Activated K+ Channel of Intermediate Conductance: A Molecular Target for Novel Treatments?" *Current Drug Targets* 2: 401-422 (2001).

Kalman, et al., "ShK-$Dap^{22}$, a Potent Kv1.3-Specific Immunosuppressive Polypeptide", *J. Biol. Chem.* 273(49): 32697-32707 (1998).

Kay, et al., "From Peptides to Drugs Via Phage Display", *Drug Disc. Today* 3(8): 370-378 (1998).

Keil, B., Specificity of Proteolysis, *Springer-Verlag Berlin-Heidelberg*—New York (1992) (Table of Contents Provided Only).

Kho, "A Tagging-Via-Substrate Technology for Detection and Proteomics of Farnesylated Proteins", *PNAS* 101(34): 12479-12484 (2004).

Köhler, et al., "Blockade of the Intermediate-Conductance Calcium-Activated Potassium Channel as a New Therapeutic Strategy for Restenosis", *Circulation*, 108: 1119-1125 (2003).

Koo, et al., "Blockade of the Voltage-Gated Potassium Channel Kv1.3 Inhibits Immune Responses in Vivo", *J. Immunol.*, 158: 5120-5128 (1997).

Koo, J., "A Randomized, Double-Blind Study Comparing the Efficacy, Safety and Optional Dose of Two Formulations of Cyclosporin, Neoral and Sandimmun, in Patients with Severe Psoriasis", *British J Derm.* 139: 88-95 (1998).

Kuai, et al., "Plasminogen Activator Inhibitor-1 Fused with Erythropoietin (EPO) Mimetic Peptide (EMP) Enhances the EPO Activity of EMP", *J. Peptide Res.* 56: 59-62 (2000).

Kuypers, R. J. D., "Immunosuppressive Drug Monitoring—What to Use in Clinical Practicer Today to Improve Renal Graft Outcome", *Trans. Internat.* 18: 140-150 (2005).

Lehmann-Horn, et al., "Voltage-Gated Ion Channels and Hereditary Disease", *Physiol. Reviews*, 79(4): 1317-1372 (1999).

Lewis, R. J. and Garcia, M. L., "Therapeutic Potential of Venom Peptides", *Nature Reviews/Drug Dis.* 2: 790-802 (2003).

Link, et al., "Non-Canonical Amino Acids in Protein Engineering", *Curr. Op. Biotech.* 14: 603-609 (2003).

Lu, et al., "Pegylated Peptides, III. Solid-Phase Synthesis with Pegylating Reagents of Varying Molecular Weight: Synthesis of Multiply Peglylated Peptides", *Reactive Polymers*, 22: 221-229 (1994).

Macian, F., "NFAT Proteins: Key Regulators of T-Cell Development and function", *Nature/Reviews/Immunol.* 5: 472-484 (2005).

Marshall, K., "Solid Oral Dosage Forms", *Modem Pharmaceutics*, Chapter 10: 359-427 (1979).

Mauler, et al., "Selective Intermediate-/Small-Conductance Calcium-Activated Potassium Channel (KCNN4) Blockers Are Potent and Effective Therapeutics in Experimental Brain Oedema and Traumatic Brain Injury Caused by Acute Subdural Haematoma", *European J. Neuroscience*, 20: 1761-1768 (2004).

Means, et al., Chemical Modification of Proteins, "Selected Techniques for the Modification of Protein Side Chains," *Holden Day, Inc.*, 214-230 (1971).

Merrifield, R.B., "Solid-Phase Peptide Synthesis. I. The Synthesis of a Tetrapeptide", *J. Am. Chem. Soc.* 85: 2149-2154 (1963).

Merrifield, R.B., "Solid-Phase Peptide Synthesis", *Chem. Polypeptides* 335-361 (1973).

Mouhat, et al., "K+ Channel Types Targeted by Synthetic OSK1, a Toxin from *Orthochirus scrobiculosus* Scorpion Venom", *Biochem J.* 385: 95-104 (2005).

Mouhat, et al., "Pharmacological Profiling of *Orthochirus scrobiculosus* Toxin 1 Analogs with a Trimmed N-Terminal Domain", *Mol. Pharmacol* 69: 354-362 (2006).

Morpurgo, et al., "Preparation and Characterization of Poly(ethylene glycol) Vinyl Sulfone", *Bioconjugate Chem.*, 7: 363-368 (1996).

Multiple Sclerosis Study Group, "Efficacy and Toxicity of Cyclosporine in Chronic Progressive Multiple Sclerosis: A Randomized, Double-blinded, Placebo-Controlled Clinical Trial", *Annals Neur.* 27(6): 591-605 (1990).

Newmark, et al., "Preparation and Properites of Adducts of Streptokinase and Streptokinase-Plasmin Complex with Polyethylene Glycol and Pluronic Polyol F38", *J. Appl. Biochem.* 4: 185-189 (1982).

Nicke, et al., "α-Conotoxins as Tools for the Elucidation of Structure and Function of Neuronal Nicotinic Acetylcholine Receptor Subtypes", *Eur J. Biochem* 271: 2305-2319 (2004).

Niemeyer, et al., "Ion Channels in Health and Disease", *EMBO Reports* 2(7): 568-573 (2001).

Pennington, et al., "Tole of Disulfide Bonds in the Structure and Potassium Channel Blocking Activity of ShK Toxin", *Biochem.* 38: 14549-14558 (1999).

Prochnicka-Chalufour, "Solution of Discrepin, a New K+ Channel Blocking Peptide from the α-KTx15 Subfamily", *Biochemistry* 45: 1795-1804 (2006).

Ptacek, L. J. and Fu, Y., "Channels and Disease—Past, Present, and Future", *Neurol. Review* 61: 1663-1668 (2004).

Quezada, et al., "CD40/CD154 Interactions at the Interface of tolerance and Immunity", *Annu. Rev. Immunol.* 22; 307-328 (2004).

Quintana, et al., "Calcium-Dependent Activation of T-Lymphocytes", *Eur. J. Physiol.* 450: 1-12 (2005).

Rauer, et al., "Structure-Guided Transformation of Charybdotoxin Yields and Analog That Selectively Targets $Ca^{2+}$-Activated Over Voltage-Gated K+ Channels", *J Biol. Chem.* 275(2): 1201-1208 (2000).

Reich, et al., "Blocking Ion Channel KCNN4 Alleviates the Symptoms of Experimental Autoimmune Encephalomyelitis in Mice", *Eur. J. Immunol.* 35: 1027-1036 (2005).

Rodríguez, et al., "Novel Interactions Between K+ Channels and Scorpion Toxins", *TRENDS in Pharmacolog. Sciences*, 24(5): 222-227 (2003).

Rohatagi, et al., "Pharmacokinetics, Pharmacodynamics, and Safety of Inhaled Cyclosporin a (ADI628) after Single and Repeated Administration in Healthy Male and Female Subjects and Asthmatic Patients", *J. Clin. Pharmacol.*, 40: 1211-1226 (2000).

Rus, H., et al. "The Voltage-Gated Potassium Channel Kv1.3 is Highly Expressed on Inflammatory Infiltrates in Multiple Sclerosis Brain", *PNAS* 102: 11094-11099 (2005).

Sandler & Karo, "Polyoxyalkylation of Hydroxy Compounds", *Polymer Synthesis*, vol. 3, Chap. 5, 138-161 (1998).

Schechter, I. and Berger, A., "On the Size of the Active Site in Proteases. I. Papain", *Biochem. and Biophys. Res. Comms.* 27(2): 157-162 (1967).

Schechter, I. and Berger, A., "On the Active Site of Proteases. III. Mapping the Active Site of Papin; Specific Peptide Inhibitors of Papain", *Biochem. and Biophys. Comms.* 32(5): 898-902.

Schmitz, et al., "Design of PAP-1, a Selective Small Molecule Kv1.3 Blocker, for the Suppression of Effector Memory T Cells in Autoimmune Diseases", *Mol. Pharmacol.* 68(5): 1254-1270 (2005).

Schroder, et al., "Interferon-γ: An Overview of Signals, Mechnisms and Functions", *J Leuk Biol* 75: 163-189 (2004).

Shakkottai, et al., Design and Characterization of a Highly Selective Peptide Inhibitor of the Small Conductance Calcium-Activated K+ Channel, SkCa2*, JBC 276: 43145 (2001).

Smith, et al., "Pulmonary Deposition and Clearance of Aerosolized Alpha-1-Proteinase Inhibitor Administered to Dogs and to Sheep" *J Clin. Invest.* 84: 1145-1146 (α1-proteinase) (1989).

Speers, et al., "Activity-Based Protein Profiling in Vivo Using a Copper(I)-Catalyzed Azide-Alkyne [3+2] Cycloaddition", *J. Am. Chem. Soc.* 125: 4686-4687 (2003).

Speers, A. E. and Cravat, B. F., "Profiling Enzyme Activities in Civo Using Click Chemistry Methods", *Chem. & Biol.* 11: 535-546 (2004).

Stewart and Young, Solid Phase Peptide Synthesis, *W.H. Freeman and Co.* (1969) (Table of Contents Provided Only).

Stocker, et al., "ICA-17043, a Novel Gardos Channel Blocker, Prevents Sickled Red blood Cell Dehydration In Vitro and In Vivo in SAD Mice", *Blood* 101: 2412-2418 (2003).

Tang, et al., "Metabolic Regulation of Potassium Channels", *Annu. Rev. Physiol.* 66: 131-159 (2003).

Todorovic, et al., "Redox Modulation of Peripheral T-type $Ca^{2+}$ Channels in Vivo: Alteration of Nerve Injury-Induced Thermal Hyperalgesia", *Pain* 109: 328-339 (2004).

Tudor, et al., "Ionisation Behaviour and Solution Properties of the Potassium-Channel Blocker ShK Toxin", *Eur. J. Biochem.* 251: 133-141 (1998).

Turk, et al., "Determination of Protease Cleavage Site Motifs Using Mixture-Based Oriented Peptide Libraries", *Nature Biol.* 19: 661-667 (2001).

Venkatesh, et al., "Chemical Genetics to Identify NFAT Inhibitors: Potential of Targeting Calcium Moblization in Immunosuppression", *PNAS* 101(24): 8969-8974 (2004).

Wilson, D. R. and Finlay, B. B., "Phage Display: Applications, Innovations, and Issues in Phage and Host Biology", *Can. J. Microbiol.* 44: 313-329 (1998).

Winslow, et al., "Calcium Signalling in Lymphocytes", *Curr. Op. Immun.* 15: 299-307 (2003).

Wulff, et al., "Delination of the Clotrimazole/TRAM-34 Binding Site on the Intermediate Conductance Calcium-Activated Potassium Channel, IKCal", *J. Biol. Chem.*, 276: 32040-32045 (2001).

Wulff, et al., "The Voltage-Gated Kv1.3 K+ Channel in Effector Memory T Cells as New Target for MS", *J. Clinical Invest.* 111(11): 1703-1713 (2003).

Wulff, et al., "K+ Channel Expression During B Cell Differentiation: Implications for Immunomodulation and Autoimmunity", *J. Immunol.*, 173: 776-786 (2004).

Yazdany, et al., "The role of CD40 Ligand in Systemic Lupus Erythematosus", *Lupus J.* 13: 377-380 (2004).

Yocum, et al., "Microemulsion formulation of Cyclosporin (Sandimmun Neoral®) vs. Sandimmun®: comparative Safety, Tolerability and Efficacy in Severe Active Rheumatoid Arthritis", *Rhem.* 39: 156-164 (2000).

Zalipsky, S., "Chemistry of Polyethylene Glycol Conjugates with Biologically Active Molecules", *Adv. Drug Delivery Rev.*, 16: 157-182 (1995).

Zalipsky, S. and Lee C.; "Use of Functionalized Poly(Ethylene Glycol)s for Modification of Polypeptides", *Poly(Ethylene /Glycol) Chemistry: Biotechnical and Biomedical Applications, J. Harris, Ed.*, Plenum Press, New York, NY, Chapter 21, 347-368 (1992).

Zhang, et al., "A New Strategy for the Site-Specific Modification of Proteins in Vivo", *Biochem.* 42: 6735-6746 (2003).

Zitt, et al., "Potent Inhibition of $Ca^{2+}$ Channels and T-Lymphocyte Activation by the Pyrazole Derivative BTP2", *J Biol Chem.* 279(13): 12427-12437 (2004).

\* cited by examiner

FIG. 3A

```
        ATGGAATGGAGCTGGGTCTTTCTCTTCTTCCTGTCAGTAACGACTGGTGTCCACTCCGAC
1790    +---------+---------+---------+---------+---------+---------  1849
        TACCTTACCTCGACCCAGAAAGAGAAGAAGGACAGTCATTGCTGACCACAGGTGAGGCTG
a       M  E  W  S  W  V  F  L  F  F  L  S  V  T  T  G  V  H  S  D    -

AAAACTCACACATGCCCACCGTGCCCAGCACCTGAACTCCTGGGGGGACCGTCAGTCTTC
1850    +---------+---------+---------+---------+---------+---------  1909
        TTTTGAGTGTGTACGGGTGGCACGGGTCGTGGACTTGAGGACCCCCCTGGCAGTCAGAAG
a       K  T  H  T  C  P  P  C  P  A  P  E  L  L  G  G  P  S  V  F    -

CTCTTCCCCCCAAAACCCAAGGACACCCTCATGATCTCCCGGACCCCTGAGGTCACATGC
1910    +---------+---------+---------+---------+---------+---------  1969
        GAGAAGGGGGGTTTTGGGTTCCTGTGGGAGTACTAGAGGGCCTGGGGACTCCAGTGTACG
a       L  F  P  P  K  P  K  D  T  L  M  I  S  R  T  P  E  V  T  C    -

GTGGTGGTGGACGTGAGCCACGAAGACCCTGAGGTCAAGTTCAACTGGTACGTGGACGGC
1970    +---------+---------+---------+---------+---------+---------  2029
        CACCACCACCTGCACTCGGTGCTTCTGGGACTCCAGTTCAAGTTGACCATGCACCTGCCG
a       V  V  V  D  V  S  H  E  D  P  E  V  K  F  N  W  Y  V  D  G    -

GTGGAGGTGCATAATGCCAAGACAAAGCCGCGGGAGGAGCAGTACAACAGCACGTACCGT
2030    +---------+---------+---------+---------+---------+---------  2089
        CACCTCCACGTATTACGGTTCTGTTTCGGCGCCCTCCTCGTCATGTTGTCGTGCATGGCA
a       V  E  V  H  N  A  K  T  K  P  R  E  E  Q  Y  N  S  T  Y  R    -

GTGGTCAGCGTCCTCACCGTCCTGCACCAGGACTGGCTGAATGGCAAGGAGTACAAGTGC
2090    +---------+---------+---------+---------+---------+---------  2149
        CACCAGTCGCAGGAGTGGCAGGACGTGGTCCTGACCGACTTACCGTTCCTCATGTTCACG
a       V  V  S  V  L  T  V  L  H  Q  D  W  L  N  G  K  E  Y  K  C    -

AAGGTCTCCAACAAAGCCCTCCCAGCCCCCATCGAGAAAACCATCTCCAAAGCCAAAGGG
2150    +---------+---------+---------+---------+---------+---------  2209
        TTCCAGAGGTTGTTTCGGGAGGGTCGGGGGTAGCTCTTTTGGTAGAGGTTTCGGTTTCCC
a       K  V  S  N  K  A  L  P  A  P  I  E  K  T  I  S  K  A  K  G    -

CAGCCCCGAGAACCACAGGTGTACACCCTGCCCCCATCCCGGGATGAGCTGACCAAGAAC
2210    +---------+---------+---------+---------+---------+---------  2269
        GTCGGGGCTCTTGGTGTCCACATGTGGGACGGGGGTAGGGCCCTACTCGACTGGTTCTTG
a       Q  P  R  E  P  Q  V  Y  T  L  P  P  S  R  D  E  L  T  K  N    -

CAGGTCAGCCTGACCTGCCTGGTCAAAGGCTTCTATCCCAGCGACATCGCCGTGGAGTGG
2270    +---------+---------+---------+---------+---------+---------  2329
        GTCCAGTCGGACTGGACGGACCAGTTTCCGAAGATAGGGTCGCTGTAGCGGCACCTCACC
a       Q  V  S  L  T  C  L  V  K  G  F  Y  P  S  D  I  A  V  E  W    -

GAGAGCAATGGGCAGCCGGAGAACAACTACAAGACCACGCCTCCCGTGCTGGACTCCGAC
2330    +---------+---------+---------+---------+---------+---------  2389
        CTCTCGTTACCCGTCGGCCTCTTGTTGATGTTCTGGTGCGGAGGGCACGACCTGAGGCTG
a       E  S  N  G  Q  P  E  N  N  Y  K  T  T  P  P  V  L  D  S  D    -
```

FIG. 3B

```
         GGCTCCTTCTTCCTCTACAGCAAGCTCACCGTGGACAAGAGCAGGTGGCAGCAGGGGAAC
2390     +---------+---------+---------+---------+---------+---------- 2449
         CCGAGGAAGAAGGAGATGTCGTTCGAGTGGCACCTGTTCTCGTCCACCGTCGTCCCCTTG
a          G   S   F   F   L   Y   S   K   L   T   V   D   K   S   R   W   Q   Q   G   N   -

GTCTTCTCATGCTCCGTGATGCATGAGGCTCTGCACAACCACTACACGCAGAAGAGCCTC
2450     +---------+---------+---------+---------+---------+---------- 2509
         CAGAAGAGTACGAGGCACTACGTACTCCGAGACGTGTTGGTGATGTGCGTCTTCTCGGAG
a          V   F   S   C   S   V   M   H   E   A   L   H   N   H   Y   T   Q   K   S   L   -

TCCCTGTCTCCGGGTAAA
2510     +---------+------- 2527
         AGGGACAGAGGCCCATTT
a          S   L   S   P   G   K   -
```

FIG. 4A

```
    ATGGACAAAACTCACACATGTCCACCTTGTCCAGCTCCGGAACTCCTGGGGGGACCGTCA
  1 ---------+---------+---------+---------+---------+---------+ 60
    TACCTGTTTTGAGTGTGTACAGGTGGAACAGGTCGAGGCCTTGAGGACCCCCCTGGCAGT a   M  D  K  T  H  T  C  P  P  C  P  A  P  E  L  L  G  G  P  S   -

GTCTTCCTCTTCCCCCCAAAACCCAAGGACACCCTCATGATCTCCCGGACCCCTGAGGTC
 61 ---------+---------+---------+---------+---------+---------+ 120
    CAGAAGGAGAAGGGGGGTTTTGGGTTCCTGTGGGAGTACTAGAGGGCCTGGGGACTCCAG a   V  F  L  F  P  P  K  P  K  D  T  L  M  I  S  R  T  P  E  V   -

ACATGCGTGGTGGTGGACGTGAGCCACGAAGACCCTGAGGTCAAGTTCAACTGGTACGTG
121 ---------+---------+---------+---------+---------+---------+ 180
    TGTACGCACCACCACCTGCACTCGGTGCTTCTGGGACTCCAGTTCAAGTTGACCATGCAC a   T  C  V  V  V  D  V  S  H  E  D  P  E  V  K  F  N  W  Y  V   -

GACGGCGTGGAGGTGCATAATGCCAAGACAAAGCCGCGGGAGGAGCAGTACAACAGCACG
181 ---------+---------+---------+---------+---------+---------+ 240
    CTGCCGCACCTCCACGTATTACGGTTCTGTTTCGGCGCCCTCCTCGTCATGTTGTCGTGC a   D  G  V  E  V  H  N  A  K  T  K  P  R  E  E  Q  Y  N  S  T   -

TACCGTGTGGTCAGCGTCCTCACCGTCCTGCACCAGGACTGGCTGAATGGCAAGGAGTAC
241 ---------+---------+---------+---------+---------+---------+ 300
    ATGGCACACCAGTCGCAGGAGTGGCAGGACGTGGTCCTGACCGACTTACCGTTCCTCATG a   Y  R  V  V  S  V  L  T  V  L  H  Q  D  W  L  N  G  K  E  Y   -

AAGTGCAAGGTCTCCAACAAAGCCCTCCCAGCCCCCATCGAGAAAACCATCTCCAAAGCC
301 ---------+---------+---------+---------+---------+---------+ 360
    TTCACGTTCCAGAGGTTGTTTCGGGAGGGTCGGGGGTAGCTCTTTTGGTAGAGGTTTCGG a   K  C  K  V  S  N  K  A  L  P  A  P  I  E  K  T  I  S  K  A   -

AAAGGGCAGCCCCGAGAACCACAGGTGTACACCCTGCCCCCATCCCGGGATGAGCTGACC
361 ---------+---------+---------+---------+---------+---------+ 420
    TTTCCCGTCGGGGCTCTTGGTGTCCACATGTGGGACGGGGGTAGGGCCCTACTCGACTGG a   K  G  Q  P  R  E  P  Q  V  Y  T  L  P  P  S  R  D  E  L  T   -

AAGAACCAGGTCAGCCTGACCTGCCTGGTCAAAGGCTTCTATCCCAGCGACATCGCCGTG
421 ---------+---------+---------+---------+---------+---------+ 480
    TTCTTGGTCCAGTCGGACTGGACGGACCAGTTTCCGAAGATAGGGTCGCTGTAGCGGCAC a   K  N  Q  V  S  L  T  C  L  V  K  G  F  Y  P  S  D  I  A  V   -

GAGTGGGAGAGCAATGGGCAGCCGGAGAACAACTACAAGACCACGCCTCCCGTGCTGGAC
481 ---------+---------+---------+---------+---------+---------+ 540
    CTCACCCTCTCGTTACCCGTCGGCCTCTTGTTGATGTTCTGGTGCGGAGGGCACGACCTG
```

TCCGACGGCTCCTTCTTCCTCTACAGCAAGCTCACCGTGGACAAGAGCAGGTGGCAGCAG
    541  ---------+---------+---------+---------+---------+---------+ 600
         AGGCTGCCGAGGAAGAAGGAGATGTCGTTCGAGTGGCACCTGTTCTCGTCCACCGTCGTC a        S   D   G   S   F   F   L   Y   S   K   L   T   V   D   K   S   R   W   Q   Q   -

GGGAACGTCTTCTCATGCTCCGTGATGCATGAGGCTCTGCACAACCACTACACGCAGAAG
    601  ---------+---------+---------+---------+---------+---------+ 660
         CCCTTGCAGAAGAGTACGAGGCACTACGTACTCCGAGACGTGTTGGTGATGTGCGTCTTC a        G   N   V   F   S   C   S   V   M   H   E   A   L   H   N   H   Y   T   Q   K   -

AGCCTCTCCCTGTCTCCGGGTAAA
    661  ---------+---------+---- 684
         TCGGAGAGGGACAGAGGCCCATTT a        S   L   S   L   S   P   G   K
```

FIG. 6A

```
                  *         20         *         40         *         60         *
HmK  : MKSQMIAAVLLIAFCLCVVTARMELQDVEDMENGFQKRRTCKDLIPVSECTDIR----CRTSMKYRLNLCRKTCGSC :  74
ShK  : ~~~~~~~~~~~~~~~~~~~~~~~~~~~~~~~~~~~~RSCIDTIPKSRCTAFQ-CKHSMKYRLSFCRKTCGTC :  35
AeK  : ~~~~~~~~~~~~~~~~~~~~~~~~~~~~~~~~~~~GCKDNFSANTCKHVKANNNC-GSQKYATNCAKTCGKC :  36
AsKS : ~~~~~~~~~~~~~~~~~~~~~~~~~~~~~~~~~~~ACKDNFAAATCKHVKENKNC-GSQKYATNCAKTCGKC :  36
BgK  : ~~~~~~~~~~~~~~~~~~~~~~~~~~~~~~~~~~~VCRDWFKETACRHAKSLGNCRTSQKYRANCAKTCELC :  37
                                       C D      C         C  S KY n C KTCg  C
```

*Predicted disulfide linkages*

FIG. 6B

| Disulfides | Disulfide Bonding |
|---|---|
| 3 | C1-C6, C2-C4, C3-C5 |

Disulfide linkage diagram

| | Sequence | | αKTx | Channels |
|---|---|---|---|---|
| BmKK1 | MKIFFAILLILAVCSMAIWTVNGTPFAIKCATDADCSRKC------PGNP----SCRNGFCACT-------- | 54 | 14.1 | |
| BmKK4 | MK-FIIVLILISVLIATIVPVNEA--QTQCQSVRDCQQYC----LTPD---RCSYGTCYCKTTGK------- | 55 | 17.1 | |
| PBTx1 | DEEPKESCSDEMCVIYCKGE-EYSTCV-CDGPQKCKCSD-------- | 37 | 11.1 | Kv |
| Tc32 | TGPQTTCQAAMCEAGCKGL-GKSMES-CQG-DTCKCKA-------- | 35 | 18.1 | Kv |
| BmKK6 | ~~MSRLFTLVLIVLAMNVMMAIISDPVVEAVGCEECPMHCK-GKNAKP--TCDDGVCNCNV-------- | 56 | 9.1 | |
| P01 | VSCEDCPEHCS--TQKAQA--KCDNDKCVCEPI-------- | 29 | 8.1 | SK |
| Pi2 | TISCTNPKQCYPHCKKETGYPNA--KCMNRKCKCFGR-------- | 47 | 7.1 | Kv |
| Pi3 | TISCTNEKQCYPHCKKETGYPNA--KCMNRKCKCFGR-------- | 35 | 7.2 | Kv |
| Pi4 | IEAIRCGGSRDCYRPCQKRTGCPNA--KCINKTCKCYGCS------- | 38 | 6.4 | |
| MTX | VSCTGSKDCYAPCRKQTGCPNA--KCINKSCKCYGC-------- | 34 | 6.2 | IK |
| Pi1 | LVKCRGTSDCGRPCQQTGCPNS--KCINRMCKCYGC-------- | 35 | 6.1 | Kv |
| HsTx1 | ASCRTPKDCADPCRKETGCPYG--KCMNRKCKCNRC-------- | 34 | 6.3 | Kv |
| AgTx2 | GVPINVSCTGSPQCIKPCKDA-GMRFG-KCMNRKCHCTPK-------- | 38 | 3.2 | Kv |
| KTX1 | GVEINVKCSGSPQCLKPCKDA-GMRFG-KCMNGKCHCTPK-------- | 38 | 3.1 | Kv |
| OSK1 | GVIINVKCKISRQCLEPCKKA-GMRFG-KCMNGKCHCTPK-------- | 38 | 3.7 | Kv |
| BmKTX | TIIDVKCTSPKQCLPPCKAQFGIRAGA-KCMNGKCKCYPH-------- | 39 | 3.6 | Kv |
| HgTx1 | TVIDVKCTSPKQCLPPCKAQFGIRAGA-KCMNGKCKCYPH-------- | 39 | 2.5 | Kv |
| MgTx | TIINVKCTSPKQCLPPCKDRFGQHAGG-KCMNGKCKCYPH-------- | 39 | 2.2 | Kv |
| Cl1Tx1 | ITINVKCTSPQQCLKPCKDA-GMRFG-KCMNGKCKCYP--------- | 38 | 2.3 | BK |
| NTX | TIINVKCTSPKQCSKPCKELTGSSAGA-KCMNGKCKCYNN-------- | 39 | 2.1 | Kv |
| Tc30 | VFINVKCRGSKECLPACKAAVCKAAG--KCMNGKCKCYP--------- | 37 | 4.4 | |
| TsTx-Ka | VFINAKCRGSPECLPKCKEAICKAAG--KCMNGKCKCYP--------- | 37 | 4.1 | |
| PBTx3 | EVDMRCKSSKECLVKCQATGRPNG--KCMNRKCRCYPR-------- | 37 | 1.10 | Kv |
| Lqh 15-1 | GLIDVRCYDSRQCWIACKKVTGSTQG--KCQNKQCRCYN--------- | 36 | 1.7 | |
| MartenTx | MKIFSILLVALIICSISICTEAFGLIDVKCFASSECWTACKKVTGSGQ--KCQNNQCRCYS--------- | 59 | 16.2 | BK |
| ChTx | MKILSVLLALIICSIVGWSEAQ-FTNVSCTTSKECWSVCQRLHNTSRG--KCMNKKCRCYS--------- | 59 | 1.1 | Kv, IK, BK |
| ChTx-Lq2 | MKILSVLLALIICSIIDWSEGQ-FTQESCTASNQCWSICKRLHNTNRG--KCMNKKCRCYS--------- | 59 | 1.2 | IK, BK |
| IbTx | Q-FTDVDCSVSKECWSVCKDLFGVDRG--KCMGKKCRCYQ--------- | 37 | 1.3 | BK |
| SloTx | T-FIDVDCTVSKECWAPCKAAFGVDRG--KCMGKKCKCYV--------- | 37 | 1.11 | BK |
| BmTx1 | ~MKISFLLALVICSI-GWSEAQ-FTDVKCTGSKQCMPVCKQMFGKPNG--KCMNGKCRCYS--------- | 57 | 1.5 | BK, Kv |

FIG. 7B

| | | | | | | |
|---|---|---|---|---|---|---|
| BuTX | ~~~~~~~~~~~~~~~~ | ~~~~~~~W

FIG. 8

| | Sequence | | Source | Target | Cys |
|---|---|---|---|---|---|
| Apamin | ~~~~~~~~~~~~~~~~CNC-KAPETAL CAR-R--CQ-QHG~~~~~~~~~~~~~~~~~~~~~~~~~~~~~~~~~~~~~~~~~ | 19 | bee | SKCa | 4 |
| HaTx1 | ECRYLFGGC-KT SD--CCK-HLGC FRDKYC AWDFTFS~~~~~~~~~~~~~~~~~~~~~~~~~~~~~~~~ | 35 | tarantula | Kv2.1 | 6 |
| ProTx1 | ECRYWLGGC-SAGQT--CCK-HLVC SRRHGW CVWDGTFS~~~~~~~~~~~~~~~~~~~~~~~~~~~~~~~ | 35 | tarantula | T type Ca | 6 |
| PaTx2 | YC QKMMWTC-D--EERKCC E-GLVCRL---WCKRIINM~~~~~~~~~~~~~~~~~~~~~~~~~~~~~~~~ | 31 | tarantula | Kv4.3 | 6 |
| ShK[2-35] | ~~~~~SC IDTIPKSRC TA--FQ CK HSMKYRLSF-C-RKT CGTC~~~~~~~~~~~~~~~~~~~~~~~~~~ | 34 | sea anemone | Kv1.3 | 6 |
| ShK[1-35] | ~~~~RSC IDTIPKSRC TA--FQ CK HSMKYRLSF-C-RKT CGTC~~~~~~~~~~~~~~~~~~~~~~~~~~ | 35 | sea anemone | Kv1.3 | 6 |
| HmK | ~~~~RTC KDLIPVSEC TD--IR CR TSMKYRLNL-C-RKT CGSC~~~~~~~~~~~~~~~~~~~~~~~~~~ | 35 | sea anemone | Kv | 6 |
| ChTx(K32E) | ~QFTNVSC--TTSK-EC WS---VC QRLHNTSRG-KC MNKEC-RCYS~~~~~~~~~~~~~~~~~~~~~~ | 37 | scorpion | IKCa | 6 |
| ChTx | ~QFTNVSC--TTSK-EC WS---VC QRLHNTSRG-KC MNKKC-RCYS~~~~~~~~~~~~~~~~~~~~~~ | 37 | scorpion | Kv1.3,IK,BK | 6 |
| IbTx | ~QFTDVDC--SVSK-EC WS---VC KDLFGVDRG-KC MGKKC-RCYQ~~~~~~~~~~~~~~~~~~~~~~ | 37 | scorpion | BKCa | 6 |
| OSK1(E16K,K20D) | ~G

FIG. 9

| Disulfide linkage diagram | Disulfides | Disulfide Bonding | Members |
|---|---|---|---|
| C1 C2 C3 C4 | 2 | C1-C3, C2-C4 | Apamin<br>α-conopeptides<br>PnIA, PnIB, MII |
| C1 C2 C3 C4 C5 C6 | 3 | C1-C6, C2-C4, C3-C5 | ShK, BgK, HmK<br>AsKS, AeK, DTX1 |
| C1 C2 C3 C4 C5 C6 | 3 | C1-C4, C2-C5, C3-C6 | ChTX, MgTx, OSK1, KTX1,<br>AgTx2, Pi2, Pi3, NTX,<br>HgTx1, BeKM1, BmKTX, P01,<br>BmKK6, Tc32, Tc1, BmTx1<br>BmTX3,Ib,Tx, P05, ScyTx,<br>TsK, MaTx1, ProTX1, PaTX2,<br>Ptu1,v GVIA,<sup>V</sup> MVIIA, SmIIIa |
| C1 C2 C3 C4 C5 C6 C7 C8 | 4 | C1-C5, C2-C6<br>C3-C7, C4-C8 | Anuroctoxin, PiI, MsTx1<br>MTX(P12A,P20A), Pi4 |
| C1 C2 C3 C4 C5 C6 C7 C8 | 4 | C1-C4, C2-C6<br>C3-C7, C5-C8 | Chlorotoxin(CTX), BM-12b |
| C1 C2 C3 C4 C5 C6 C7 C8 | 4 | C1-C5, C2-C6<br>C3-C4, C7-C8 | Maurotoxin(MTX) |

FIG. 11A

```
     NdeI
      |
     CATATGGACAAAACTCACACATGTCCACCTTGTCCAGCTCCGGAACTCCTGGGGGGACCG
5131 ---------+---------+---------+---------+---------+---------+ 5190
     GTATACCTGTTTTGAGTGTGTACAGGTGGAACAGGTCGAGGCCTTGAGGACCCCCCTGGC

M  D  K  T  H  T  C  P  P  C  P  A  P  E  L  L  G  G  P   -

TCAGTCTTCCTCTTCCCCCCAAAACCCAAGGACACCCTCATGATCTCCCGGACCCCTGAG
5191 ---------+---------+---------+---------+---------+---------+ 5250
     AGTCAGAAGGAGAAGGGGGGTTTTGGGTTCCTGTGGGAGTACTAGAGGGCCTGGGGACTC

S  V  F  L  F  P  P  K  P  K  D  T  L  M  I  S  R  T  P  E -

GTCACATGCGTGGTGGTGGACGTGAGCCACGAAGACCCTGAGGTCAAGTTCAACTGGTAC
5251 ---------+---------+---------+---------+---------+---------+ 5310
     CAGTGTACGCACCACCACCTGCACTCGGTGCTTCTGGGACTCCAGTTCAAGTTGACCATG

V  T  C  V  V  V  D  V  S  H  E  D  P  E  V  K  F  N  W  Y -

GTGGACGGCGTGGAGGTGCATAATGCCAAGACAAAGCCGCGGGAGGAGCAGTACAACAGC
5311 ---------+---------+---------+---------+---------+---------+ 5370
     CACCTGCCGCACCTCCACGTATTACGGTTCTGTTTCGGCGCCCTCCTCGTCATGTTGTCG

V  D  G  V  E  V  H  N  A  K  T  K  P  R  E  E  Q  Y  N  S - acgtaccgtgtggtcagcgtcctcaccgtcctgcaccaggactggctgaatggcaaggag
5371 ---------+---------+---------+---------+---------+---------+ 5430
     tgcatggcacaccagtcgcaggagtggcaggacgtggtcctgaccgacttaccgttcctc

T  Y  R  V  V  S  V  L  T  V  L  H  Q  D  W  L  N  G  K  E - tacaagtgcaaggtctccaacaaagccctcccagcccccatcgagaaaaccatctccaaa
5431 ---------+---------+---------+---------+---------+---------+ 5490
     atgttcacgttccagaggttgtttcgggagggtcgggggtagctcttttggtagaggttt

Y  K  C  K  V  S  N  K  A  L  P  A  P  I  E  K  T  I  S  K - gccaaagggcagccccGAGAACCACAGGTGTACACCCTGCCCCCATCCCGGGATGAGCTG
5491 ---------+---------+---------+---------+---------+---------+ 5550
     cggtttcccgtcggggGCTCTTGGTGTCCACATGTGGGACGGGGGTAGGGCCCTACTCGAC

A  K  G  Q  P  R  E  P  Q  V  Y  T  L  P  P  S  R  D  E  L -

ACCAAGAACCAGGTCAGCCTGACCTGCCTGGTCAAAGGCTTCTATCCCAGCGACATCGCC
5551 ---------+---------+---------+---------+---------+---------+ 5610
     TGGTTCTTGGTCCAGTCGGACTGGACGGACCAGTTTCCGAAGATAGGGTCGCTGTAGCGG

T  K  N  Q  V  S  L  T  C  L  V  K  G  F  Y  P  S  D  I  A -

GTGGAGTGGGAGAGCAATGGGCAGCCGGAGAACAACTACAAGACCACGCCTCCCGTGCTG
5611 ---------+---------+---------+---------+---------+---------+ 5670
     CACCTCACCCTCTCGTTACCCGTCGGCCTCTTGTTGATGTTCTGGTGCGGAGGGCACGAC

```
       GACTCCGACGGCTCCTTCTTCCTCTACAGCAAGCTCACCGTGGACAAGAGCAGGTGGCAG
5671   ---------+---------+---------+---------+---------+---------+ 5730
       CTGAGGCTGCCGAGGAAGAAGGAGATGTCGTTCGAGTGGCACCTGTTCTCGTCCACCGTC

D  S  D  G  S  F  F  L  Y  S  K  L  T  V  D  K  S  R  W  Q   -

CAGGGGAACGTCTTCTCATGCTCCGTGATGCATGAGGCTCTGCACAACCACTACACGCAG
5731   ---------+---------+---------+---------+---------+---------+ 5790
       GTCCCCTTGCAGAAGAGTACGAGGCACTACGTACTCCGAGACGTGTTGGTGATGTGCGTC

Q  G  N  V  F  S  C  S  V  M  H  E  A  L  H  N  H  Y  T  Q   -

BsmBI
                                                          |
       AAGAGCCTCTCCCTGTCTCCGGGTAAAGGTGGAGGTGGTGGTTGAGACGCTGCAGGACGT
5791   ---------+---------+---------+---------+---------+---------+ 5850
       TTCTCGGAGAGGGACAGAGGCCCATTTCCACCTCCACCACCAACTCTGCGACGTCCTGCA

K  S  L  S  L  S  P  G  K  G  G  G  G                        -

TGATCGGCACGTAAGAGGTTCCAACTTTCACCATAATGAAATAAGATCACTACCGGGCGT
5851   ---------+---------+---------+---------+---------+---------+ 5910
       ACTAGCCGTGCATTCTCCAAGGTTGAAAGTGGTATTACTTTATTCTAGTGATGGCCCGCA

ATTTTTTGAGTTATCGAGATTTTCAGGAGCTAAGGAAGCCAAAATGGAGAAAAAAATCAC
5911   ---------+---------+---------+---------+---------+---------+ 5970
       TAAAAAACTCAATAGCTCTAAAAGTCCTCGATTCCTTCGGTTTTACCTCTTTTTTTAGTG

M  E  K  K  I  T   -

TGGATATACCACCgttgatatatcccaatggcatcgtaaagaacattttTGaggcatTtca
5971   ---------+---------+---------+---------+---------+---------+ 6030
       ACCTATATGGTGGcaactatatagggttaccgtagcatttcttgtaaaACtccgtaAagt

G  Y  T  T  V  D  I  S  Q  W  H  R  K  E  H  F  E  A  F  Q    - gtcagttgctcaatgtacctataaccagaccgttcagctggatattacggcctttttaaa
6031   ---------+---------+---------+---------+---------+---------+ 6090
       cagtcaacgagttacatggatattggtctggcaagtcgacctataatgccggaaaaattt

S  V  A  Q  C  T  Y  N  Q  T  V  Q  L  D  I  T  A  F  L  K    - gaccgtaaagaaaaataagcacaagttttatccggcctttattcacattcttgcccgcct
6091   ---------+---------+---------+---------+---------+---------+ 6150
       ctggcatttcttttattcgtgttcaaaataggccggaaataagtgtaagaacgggcgga

T  V  K  K  N  K  H  K  F  Y  P  A  F  I  H  I  L  A  R  L    - gatgaatgctcatccggaattccgtatggcaATGAAAGACGGTGAGCTGGTGATATGGGA
6151   ---------+---------+---------+---------+---------+---------+ 6210
       ctacttacgagtaggccttaaggcataccgtTACTTTCTGCCACTCGACCACTATACCCT

```
       TAGTGTTCACCCTTGTTACACCGTTTTCCATGAGCAAACTGAAACGTTTTCATCGCTATG
6211   ---------+---------+---------+---------+---------+---------+ 6270
       ATCACAAGTGGGAACAATGTGGCAAAAGGTACTCGTTTGACTTTGCAAAAGTAGCGATAC

S   V   H   P   C   Y   T   V   F   H   E   Q   T   E   T   F   S   S   L   W   -

GAGTGAATACCACGACGATTCCCGGCAGTTTCTACACATATATTCGCAAGATGTGGCGTG
6271   ---------+---------+---------+---------+---------+---------+ 6330
       CTCACTTATGGTGCTGCTAAGGGCCGTCAAAGATGTGTATATAAGCGTTCTACACCGCAC

S   E   Y   H   D   D   S   R   Q   F   L   H   I   Y   S   Q   D   V   A   C   -

TTACGGTGAAAACCTGGCCTATTTCCCTAAAGGGTTTATTGAGAATATGTTTTTCGTTTC
6331   ---------+---------+---------+---------+---------+---------+ 6390
       AATGCCACTTTTGGACCGGATAAAGGGATTTCCCAAATAACTCTTATACAAAAAGCAAAG

Y   G   E   N   L   A   Y   F   P   K   G   F   I   E   N   M   F   F   V   S   -

AGCCAATCCCTGGGTGAGTTTCACCAGTTTTGATTTAAACGTGGCCAATATGGACAACTT
6391   ---------+---------+---------+---------+---------+---------+ 6450
       TCGGTTAGGGACCCACTCAAAGTGGTCAAAACTAAATTTGCACCGGTTATACCTGTTGAA

A   N   P   W   V   S   F   T   S   F   D   L   N   V   A   N   M   D   N   F   -

CTTCGCCCCCGTTTTCACCATGGGCAAATATTATACGCAAGGCGACAAGGTGCTGATGCC
6451   ---------+---------+---------+---------+---------+---------+ 6510
       GAAGCGGGGGCAAAAGTGGTACCCGTTTATAATATGCGTTCCGCTGTTCCACGACTACGG

F   A   P   V   F   T   M   G   K   Y   Y   T   Q   G   D   K   V   L   M   P   -

GCTGGCGATTCAGGTTCATCATGCCGTTTGTGATGGCTTCCATGTCGGCAGAATGCTTAA
6511   ---------+---------+---------+---------+---------+---------+ 6570
       CGACCGCTAAGTCCAAGTAGTACGGCAAACACTACCGAAGGTACAGCCGTCTTACGAATT

L   A   I   Q   V   H   H   A   V   C   D   G   F   H   V   G   R   M   L   N   -

TGAATTACAACAGTACTGCGATGAGTGGCGGGGCGGGGCGTAATTTTTTTAAGGCAGTTA
6571   ---------+---------+---------+---------+---------+---------+ 6630
       ACTTAATGTTGTCATGACGCTACTCACCGCCCCGCCCCGCATTAAAAAAATTCCGTCAAT

E   L   Q   Q   Y   C   D   E   W   R   G   G   A   *                           -

BamHI
                  BsmBI      |
                    |        |
       TTGGTGGCGCGCCCGTCTCTTAAGGATCCG
6631   ---------+---------+---------+ 6660
       AACCACCGCGCGGGCAGAGAATTCCTAGGC
```

FIG. 12A

```
   BsmBI
    NdeI
       |
       CATATGCGAGACGGGGCGGTGTTGACAATTAATCATCGGCATAGTATATCGGCATAGTAT
5131   ---------+---------+---------+---------+---------+---------+ 5190
       GTATACGCTCTGCCCCGCCACAACTGTTAATTAGTAGCCGTATCATATAGCCGTATCATA

M

AATACGACAAGGTGAGGAACTAAACCATGGCCAAGTTGACCAGTGCCGTTCCGGTGCTCA
5191   ---------+---------+---------+---------+---------+---------+ 5250
       TTATGCTGTTCCACTCCTTGATTTGGTACCGGTTCAACTGGTCACGGCAAGGCCACGAGT

M   A   K   L   T   S   A   V   P   V   L   T -

CCGCGCGCGACGTCGCCGGAGCGGTCGAGTTCTGGACCGACCGGCTCGGGTTCTCCCGGG
5251   ---------+---------+---------+---------+---------+---------+ 5310
       GGCGCGCGCTGCAGCGGCCTCGCCAGCTCAAGACCTGGCTGGCCGAGCCCAAGAGGGCCC

A   R   D   V   A   G   A   V   E   F   W   T   D   R   L   G   F   S   R   D -

ACTTCGTGGAGGACGACTTCGCCGGTGTGGTCCGGGACGACGTGACCCTGTTCATCAGCG
5311   ---------+---------+---------+---------+---------+---------+ 5370
       TGAAGCACCTCCTGCTGAAGCGGCCACACCAGGCCCTGCTGCACTGGGACAAGTAGTCGC

F   V   E   D   D   F   A   G   V   V   R   D   D   V   T   L   F   I   S   A -

CGGTCCAGGACCAGGTGGTGCCGGACAACACCCTGGCCTGGGTGTGGGTGCGCGGCCTGG
5371   ---------+---------+---------+---------+---------+---------+ 5430
       GCCAGGTCCTGGTCCACCACGGCCTGTTGTGGGACCGGACCCACACCCACGCGCCGGACC

V   Q   D   Q   V   V   P   D   N   T   L   A   W   V   W   V   R   G   L   D -

ACGAGCTGTACGCCGAGTGGTCGGAGGTCGTGTCCACGAACTTCCGGGACGCCTCCGGGC
5431   ---------+---------+---------+---------+---------+---------+ 5490
       TGCTCGACATGCGGCTCACCAGCCTCCAGCACAGGTGCTTGAAGGCCCTGCGGAGGCCCG

E   L   Y   A   E   W   S   E   V   V   S   T   N   F   R   D   A   S   G   P -

CGGCCATGACCGAGATCGGCGAGCAGCCGTGGGGCGGGAGTTCGCCCTGCGCGACCCGG
5491   ---------+---------+---------+---------+---------+---------+ 5550
       GCCGGTACTGGCTCTAGCCGCTCGTCGGCACCCCGCCCTCAAGCGGGACGCGCTGGGCC

A   M   T   E   I   G   E   Q   P   W   G   R   E   F   A   L   R   D   P   A -

CCGGCAACTGCGTGCACTTCGTGGCCGAGGAGCAGGACTGACACGTCCGACGGCGGCGTC
5551   ---------+---------+---------+---------+---------+---------+ 5610
       GGCCGTTGACGCACGTGAAGCACCGGCTCCTCGTCCTGACTGTGCAGGCTGCCGCCGCAG

```
     BsmBI
      |
     TCAGGTGGTGGTGGTGGTGACAAAACTCACACATGCCCACCGTGCCCAGCACCTGAACTC
5611 ---------+---------+---------+---------+---------+---------+ 5670
     AGTCCACCACCACCACCACTGTTTTGAGTGTGTACGGGTGGCACGGGTCGTGGACTTGAG

G  G  G  G  G  D  K  T  H  T  C  P  P  C  P  A  P  E  L   -

CTGGGGGGACCGTCAGTCTTCCTCTTCCCCCCAAAACCCAAGGACACCCTCATGATCTCC
5671 ---------+---------+---------+---------+---------+---------+ 5730
     GACCCCCCTGGCAGTCAGAAGGAGAAGGGGGGTTTTGGGTTCCTGTGGGAGTACTAGAGG

L  G  G  P  S  V  F  L  F  P  P  K  P  K  D  T  L  M  I  S   -

CGGACCCCTGAGGTCACATGCGTGGTGGTGGACGTGAGCCACGAAGACCCTGAGGTCAAG
5731 ---------+---------+---------+---------+---------+---------+ 5790
     GCCTGGGGACTCCAGTGTACGCACCACCACCTGCACTCGGTGCTTCTGGGACTCCAGTTC

R  T  P  E  V  T  C  V  V  V  D  V  S  H  E  D  P  E  V  K   -

TTCAACTGGTACGTGGACGGCGTGGAGGTGCATAATGCCAAGACAAAGCCGCGGGAGGAG
5791 ---------+---------+---------+---------+---------+---------+ 5850
     AAGTTGACCATGCACCTGCCGCACCTCCACGTATTACGGTTCTGTTTCGGCGCCCTCCTC

F  N  W  Y  V  D  G  V  E  V  H  N  A  K  T  K  P  R  E  E   -

CAGTACAACAGCACGTACCGTGTGGTCAGCGTCCTCACCGTCCTGCACCAGGACTGGCTG
5851 ---------+---------+---------+---------+---------+---------+ 5910
     GTCATGTTGTCGTGCATGGCACACCAGTCGCAGGAGTGGCAGGACGTGGTCCTGACCGAC

Q  Y  N  S  T  Y  R  V  V  S  V  L  T  V  L  H  Q  D  W  L   -

AATGGCAAGGAGTACAAGTGCAAGGTCTCCAACAAAGCCCTCCCAGCCCCCATCGAGAAA
5911 ---------+---------+---------+---------+---------+---------+ 5970
     TTACCGTTCCTCATGTTCACGTTCCAGAGGTTGTTTCGGGAGGGTCGGGGGTAGCTCTTT

N  G  K  E  Y  K  C  K  V  S  N  K  A  L  P  A  P  I  E  K   -

ACCATCTCCAAAGCCAAAGGGCAGCCCCGAGAACCACAGGTGTACACCCTGCCCCCATCC
5971 ---------+---------+---------+---------+---------+---------+ 6030
     TGGTAGAGGTTTCGGTTTCCCGTCGGGGCTCTTGGTGTCCACATGTGGGACGGGGGTAGG

T  I  S  K  A  K  G  Q  P  R  E  P  Q  V  Y  T  L  P  P  S   -

CGGGATGAGCTGACCAAGAACCAGGTCAGCCTGACCTGCCTGGTCAAAGGCTTCTATCCC
6031 ---------+---------+---------+---------+---------+---------+ 6090
     GCCCTACTCGACTGGTTCTTGGTCCAGTCGGACTGGACGGACCAGTTTCCGAAGATAGGG
```

AGCGACATCGCCGTGGAGTGGGAGAGCAATGGGCAGCCGGAGAACAACTACAAGACCACG
 6091  ---------+---------+---------+---------+---------+---------+  6150
       TCGCTGTAGCGGCACCTCACCCTCTCGTTACCCGTCGGCCTCTTGTTGATGTTCTGGTGC

S   D   I   A   V   E   W   E   S   N   G   Q   P   E   N   N   Y   K   T   T   -

CCTCCCGTGCTGGACTCCGACGGCTCCTTCTTCCTCTACAGCAAGCTCACCGTGGACAAG
 6151  ---------+---------+---------+---------+---------+---------+  6210
       GGAGGGCACGACCTGAGGCTGCCGAGGAAGAAGGAGATGTCGTTCGAGTGGCACCTGTTC

P   P   V   L   D   S   D   G   S   F   F   L   Y   S   K   L   T   V   D   K   -

AGCAGGTGGCAGCAGGGGAACGTCTTCTCATGCTCCGTGATGCATGAGGCTCTGCACAAC
 6211  ---------+---------+---------+---------+---------+---------+  6270
       TCGTCCACCGTCGTCCCCTTGCAGAAGAGTACGAGGCACTACGTACTCCGAGACGTGTTG

S   R   W   Q   Q   G   N   V   F   S   C   S   V   M   H   E   A   L   H   N   -

BamHI
                                                          |
       CACTACACGCAGAAGAGCCTCTCCCTGTCTCCGGGTAAATAATGGATCC
 6271  ---------+---------+---------+---------+---------  6319
       GTGATGTGCGTCTTCTCGGAGAGGGACAGAGGCCCATTTATTACCTAGG

H   Y   T   Q   K   S   L   S   L   S   P   G   K   *
``` pAMG21ampR-Pep-Fc

FIG. 12E

```
         BsmBI
    NdeI  |
     |   |
      CATATGGGTCGAGACGGGGCGGTGTTGACAATTAATCATCGGCATAGTATATCGGCATAG
5131  ---------+---------+---------+---------+---------+---------+ 5190
      GTATACCCAGCTCTGCCCCGCCACAACTGTTAATTAGTAGCCGTATCATATAGCCGTATC

M  G                                                      -

TATAATACGACAAGGTGAGGAACTAAACCATGGCCAAGTTGACCAGTGCCGTTCCGGTGC
5191  ---------+---------+---------+---------+---------+---------+ 5250
      ATATTATGCTGTTCCACTCCTTGATTTGGTACCGGTTCAACTGGTCACGGCAAGGCCACG

*  Y  D  K  V  R  N  *  T  M  A  K  L  T  S  A  V  P  V  L -

TCACCGCGCGCGACGTCGCCGGAGCGGTCGAGTTCTGGACCGACCGGCTCGGGTTCTCCC
5251  ---------+---------+---------+---------+---------+---------+ 5310
      AGTGGCGCGCGCTGCAGCGGCCTCGCCAGCTCAAGACCTGGCTGGCCGAGCCCAAGAGGG

T  A  R  D  V  A  G  A  V  E  F  W  T  D  R  L  G  F  S  R -

GGGACTTCGTGGAGGACGACTTCGCCGGTGTGGTCCGGGACGACGTGACCCTGTTCATCA
5311  ---------+---------+---------+---------+---------+---------+ 5370
      CCCTGAAGCACCTCCTGCTGAAGCGGCCACACCAGGCCCTGCTGCACTGGGACAAGTAGT

D  F  V  E  D  D  F  A  G  V  V  R  D  D  V  T  L  F  I  S -

GCGCGGTCCAGGACCAGGTGGTGCCGGACAACACCCTGGCCTGGGTGTGGGTGCGCGGCC
5371  ---------+---------+---------+---------+---------+---------+ 5430
      CGCGCCAGGTCCTGGTCCACCACGGCCTGTTGTGGGACCGGACCCACACCCACGCGCCGG

A  V  Q  D  Q  V  V  P  D  N  T  L  A  W  V  W  V  R  G  L -

TGGACGAGCTGTACGCCGAGTGGTCGGAGGTCGTGTCCACGAACTTCCGGGACGCCTCCG
5431  ---------+---------+---------+---------+---------+---------+ 5490
      ACCTGCTCGACATGCGGCTCACCAGCCTCCAGCACAGGTGCTTGAAGGCCCTGCGGAGGC

D  E  L  Y  A  E  W  S  E  V  V  S  T  N  F  R  D  A  S  G -

GGCCGGCCATGACCGAGATCGGCGAGCAGCCGTGGGGGCGGGAGTTCGCCCTGCGCGACC
5491  ---------+---------+---------+---------+---------+---------+ 5550
      CCGGCCGGTACTGGCTCTAGCCGCTCGTCGGCACCCCCGCCCTCAAGCGGGACGCGCTGG

P  A  M  T  E  I  G  E  Q  P  W  G  R  E  F  A  L  R  D  P -

CGGCCGGCAACTGCGTGCACTTCGTGGCCGAGGAGCAGGACTGACACGTCCGACGGCGGC
5551  ---------+---------+---------+---------+---------+---------+ 5610
      GCCGGCCGTTGACGCACGTGAAGCACCGGCTCCTCGTCCTGACTGTGCAGGCTGCCGCCG

```
     BsmBI
      |
     GTCTCAGGTGGTGGTGGTGGTGACAAAACTCACACATGCCCACCGTGCCCAGCACCTGAA
5611 ---------+---------+---------+---------+---------+---------+ 5670
     CAGAGTCCACCACCACCACCACTGTTTTGAGTGTGTACGGGTGGCACGGGTCGTGGACTT

G  G  G  G  D  K  T  H  T  C  P  P  C  P  A  P  E    -

CTCCTGGGGGGACCGTCAGTCTTCCTCTTCCCCCCAAAACCCAAGGACACCCTCATGATC
5671 ---------+---------+---------+---------+---------+---------+ 5730
     GAGGACCCCCCTGGCAGTCAGAAGGAGAAGGGGGGTTTTGGGTTCCTGTGGGAGTACTAG

L  L  G  G  P  S  V  F  L  F  P  P  K  P  K  D  T  L  M  I   -

TCCCGGACCCCTGAGGTCACATGCGTGGTGGTGGACGTGAGCCACGAAGACCCTGAGGTC
5731 ---------+---------+---------+---------+---------+---------+ 5790
     AGGGCCTGGGGACTCCAGTGTACGCACCACCACCTGCACTCGGTGCTTCTGGGACTCCAG

S  R  T  P  E  V  T  C  V  V  V  D  V  S  H  E  D  P  E  V   -

AAGTTCAACTGGTACGTGGACGGCGTGGAGGTGCATAATGCCAAGACAAAGCCGCGGGAG
5791 ---------+---------+---------+---------+---------+---------+ 5850
     TTCAAGTTGACCATGCACCTGCCGCACCTCCACGTATTACGGTTCTGTTTCGGCGCCCTC

K  F  N  W  Y  V  D  G  V  E  V  H  N  A  K  T  K  P  R  E   -

GAGCAGTACAACAGCACGTACCGTGTGGTCAGCGTCCTCACCGTCCTGCACCAGGACTGG
5851 ---------+---------+---------+---------+---------+---------+ 5910
     CTCGTCATGTTGTCGTGCATGGCACACCAGTCGCAGGAGTGGCAGGACGTGGTCCTGACC

E  Q  Y  N  S  T  Y  R  V  V  S  V  L  T  V  L  H  Q  D  W   -

CTGAATGGCAAGGAGTACAAGTGCAAGGTCTCCAACAAAGCCCTCCCAGCCCCCATCGAG
5911 ---------+---------+---------+---------+---------+---------+ 5970
     GACTTACCGTTCCTCATGTTCACGTTCCAGAGGTTGTTTCGGGAGGGTCGGGGGTAGCTC

L  N  G  K  E  Y  K  C  K  V  S  N  K  A  L  P  A  P  I  E   -

AAAACCATCTCCAAAGCCAAAGGGCAGCCCCGAGAACCACAGGTGTACACCCTGCCCCCA
5971 ---------+---------+---------+---------+---------+---------+ 6030
     TTTTGGTAGAGGTTTCGGTTTCCCGTCGGGGCTCTTGGTGTCCACATGTGGGACGGGGGT

K  T  I  S  K  A  K  G  Q  P  R  E  P  Q  V  Y  T  L  P  P   -

TCCCGGGATGAGCTGACCAAGAACCAGGTCAGCCTGACCTGCCTGGTCAAAGGCTTCTAT
6031 ---------+---------+---------+---------+---------+---------+ 6090
     AGGGCCCTACTCGACTGGTTCTTGGTCCAGTCGGACTGGACGGACCAGTTTCCGAAGATA

```
       CCCAGCGACATCGCCGTGGAGTGGGAGAGCAATGGGCAGCCGGAGAACAACTACAAGACC
6091   ---------+---------+---------+---------+---------+---------+ 6150
       GGGTCGCTGTAGCGGCACCTCACCCTCTCGTTACCCGTCGGCCTCTTGTTGATGTTCTGG

P   S   D   I   A   V   E   W   E   S   N   G   Q   P   E   N   N   Y   K   T   -

ACGCCTCCCGTGCTGGACTCCGACGGCTCCTTCTTCCTCTACAGCAAGCTCACCGTGGAC
6151   ---------+---------+---------+---------+---------+---------+ 6210
       TGCGGAGGGCACGACCTGAGGCTGCCGAGGAAGAAGGAGATGTCGTTCGAGTGGCACCTG

T   P   P   V   L   D   S   D   G   S   F   F   L   Y   S   K   L   T   V   D   -

AAGAGCAGGTGGCAGCAGGGGAACGTCTTCTCATGCTCCGTGATGCATGAGGCTCTGCAC
6211   ---------+---------+---------+---------+---------+---------+ 6270
       TTCTCGTCCACCGTCGTCCCCTTGCAGAAGAGTACGAGGCACTACGTACTCCGAGACGTG

K   S   R   W   Q   Q   G   N   V   F   S   C   S   V   M   H   E   A   L   H   -

BamHI
                                                         |
       AACCACTACACGCAGAAGAGCCTCTCCCTGTCTCCGGGTAAATAATGGATCC
6271   ---------+---------+---------+---------+---------+-- 6322
       TTGGTGATGTGCGTCTTCTCGGAGAGGGACAGAGGCCCATTTATTACCTAGG

```
         ATGGAATGGAGCTGGGTCTTTCTCTTCTTCCTGTCAGTAACGACTGGTGTCCACTCCGAC
    1    ---------+---------+---------+---------+---------+---------+  60
         TACCTTACCTCGACCCAGAAAGAGAAGAAGGACAGTCATTGCTGACCACAGGTGAGGCTG
a        M  E  W  S  W  V  F  L  F  F  L  S  V  T  T  G  V  H  S  D   -
         AAAACTCACACATGCCCACCGTGCCCAGCACCTGAACTCCTGGGGGGACCGTCAGTCTTC
    61   ---------+---------+---------+---------+---------+---------+  120
         TTTTGAGTGTGTACGGGTGGCACGGGTCGTGGACTTGAGGACCCCCCTGGCAGTCAGAAG
a        K  T  H  T  C  P  P  C  P  A  P  E  L  L  G  G  P  S  V  F   -
         CTCTTCCCCCCAAAACCCAAGGACACCCTCATGATCTCCCGGACCCCTGAGGTCACATGC
    121  ---------+---------+---------+---------+---------+---------+  180
         GAGAAGGGGGGTTTTGGGTTCCTGTGGGAGTACTAGAGGGCCTGGGGACTCCAGTGTACG
a        L  F  P  P  K  P  K  D  T  L  M  I  S  R  T  P  E  V  T  C   -
         GTGGTGGTGGACGTGAGCCACGAAGACCCTGAGGTCAAGTTCAACTGGTACGTGGACGGC
    181  ---------+---------+---------+---------+---------+---------+  240
         CACCACCACCTGCACTCGGTGCTTCTGGGACTCCAGTTCAAGTTGACCATGCACCTGCCG
a        V  V  V  D  V  S  H  E  D  P  E  V  K  F  N  W  Y  V  D  G   -
         GTGGAGGTGCATAATGCCAAGACAAAGCCGCGGGAGGAGCAGTACAACAGCACGTACCGT
    241  ---------+---------+---------+---------+---------+---------+  300
         CACCTCCACGTATTACGGTTCTGTTTCGGCGCCCTCCTCGTCATGTTGTCGTGCATGGCA
a        V  E  V  H  N  A  K  T  K  P  R  E  E  Q  Y  N  S  T  Y  R   -
         GTGGTCAGCGTCCTCACCGTCCTGCACCAGGACTGGCTGAATGGCAAGGAGTACAAGTGC
    301  ---------+---------+---------+---------+---------+---------+  360
         CACCAGTCGCAGGAGTGGCAGGACGTGGTCCTGACCGACTTACCGTTCCTCATGTTCACG
a        V  V  S  V  L  T  V  L  H  Q  D  W  L  N  G  K  E  Y  K  C   -
         AAGGTCTCCAACAAAGCCCTCCCAGCCCCCATCGAGAAAACCATCTCCAAAGCCAAAGGG
    361  ---------+---------+---------+---------+---------+---------+  420
         TTCCAGAGGTTGTTTCGGGAGGGTCGGGGGTAGCTCTTTTGGTAGAGGTTTCGGTTTCCC
a        K  V  S  N  K  A  L  P  A  P  I  E  K  T  I  S  K  A  K  G   -
         CAGCCCCGAGAACCACAGGTGTACACCCTGCCCCCATCCCGGGATGAGCTGACCAAGAAC
    421  ---------+---------+---------+---------+---------+---------+  480
         GTCGGGGCTCTTGGTGTCCACATGTGGGACGGGGGTAGGGCCCTACTCGACTGGTTCTTG
a        Q  P  R  E  P  Q  V  Y  T  L  P  P  S  R  D  E  L  T  K  N   -
         CAGGTCAGCCTGACCTGCCTGGTCAAAGGCTTCTATCCCAGCGACATCGCCGTGGAGTGG
    481  ---------+---------+---------+---------+---------+---------+  540
         GTCCAGTCGGACTGGACGGACCAGTTTCCGAAGATAGGGTCGCTGTAGCGGCACCTCACC
a        Q  V  S  L  T  C  L  V  K  G  F  Y  P  S  D  I  A  V  E  W   -
         GAGAGCAATGGGCAGCCGGAGAACAACTACAAGACCACGCCTCCCGTGCTGGACTCCGAC
    541  ---------+---------+---------+---------+---------+---------+  600
         CTCTCGTTACCCGTCGGCCTCTTGTTGATGTTCTGGTGCGGAGGGCACGACCTGAGGCTG
a        E  S  N  G  Q  P  E  N  N  Y  K  T  T  P  P  V  L  D  S  D   -
         GGCTCCTTCTTCCTCTACAGCAAGCTCACCGTGGACAAGAGCAGGTGGCAGCAGGGGAAC
    601  ---------+---------+---------+---------+---------+---------+  660
         CCGAGGAAGAAGGAGATGTCGTTCGAGTGGCACCTGTTCTCGTCCACCGTCGTCCCCTTG
a        G  S  F  F  L  Y  S  K  L  T  V  D  K  S  R  W  Q  Q  G  N   -
         GTCTTCTCATGCTCCGTGATGCATGAGGCTCTGCACAACCACTACACGCAGAAGAGCCTC
    661  ---------+---------+---------+---------+---------+---------+  720
         CAGAAGAGTACGAGGCACTACGTACTCCGAGACGTGTTGGTGATGTGCGTCTTCTCGGAG
a        V  F  S  C  S  V  M  H  E  A  L  H  N  H  Y  T  Q  K  S  L   -
```

FIG. 14B

```
     TCCCTGTCTCCGGGTAAAGGAGGAGGAGGATCCGGAGGAGGAGGAAGCCGCAGCTGCATC
721  ---------+---------+---------+---------+---------+---------+ 780
     AGGGACAGAGGCCCATTTCCTCCTCCTCCTAGGCCTCCTCCTCCTTCGGCGTCGACGTAG
a      S  L  S  P  G  K  G  G  G  G  S  G  G  G  G  S  R  S  C  I  -
     GACACCATCCCCAAGAGCCGCTGCACCGCCTTCCAGTGCAAGCACAGCATGAAGTACCGC
781  ---------+---------+---------+---------+---------+---------+ 840
     CTGTGGTAGGGGTTCTCGGCGACGTGGCGGAAGGTCACGTTCGTGTCGTACTTCATGGCG
a      D  T  I  P  K  S  R  C  T  A  F  Q  C  K  H  S  M  K  Y  R  -
     CTGAGCTTCTGCCGCAAGACCTGCGGCACCTGCTAATGA
841  ---------+---------+---------+--------- 879
     GACTCGAAGACGGCGTTCTGGACGCCGTGGACGATTACT
a      L  S  F  C  R  K  T  C  G  T  C  *  *  -
```

FIG. 15A

```
        ATGGAATGGAGCTGGGTCTTTCTCTTCTTCCTGTCAGTAACGACTGGTGTCCACTCCGAC
    1   ---------+---------+---------+---------+---------+---------+  60
        TACCTTACCTCGACCCAGAAAGAGAAGAAGGACAGTCATTGCTGACCACAGGTGAGGCTG
a        M  E  W  S  W  V  F  L  F  F  L  S  V  T  T  G  V  H  S  D   -

AAAACTCACACATGCCCACCGTGCCCAGCACCTGAACTCCTGGGGGGACCGTCAGTCTTC
   61   ---------+---------+---------+---------+---------+---------+ 120
        TTTTGAGTGTGTACGGGTGGCACGGGTCGTGGACTTGAGGACCCCCCTGGCAGTCAGAAG
a        K  T  H  T  C  P  P  C  P  A  P  E  L  L  G  G  P  S  V  F   -

CTCTTCCCCCCAAAACCCAAGGACACCCTCATGATCTCCCGGACCCCTGAGGTCACATGC
  121   ---------+---------+---------+---------+---------+---------+ 180
        GAGAAGGGGGGTTTTGGGTTCCTGTGGGAGTACTAGAGGGCCTGGGGACTCCAGTGTACG
a        L  F  P  P  K  P  K  D  T  L  M  I  S  R  T  P  E  V  T  C   -

GTGGTGGTGGACGTGAGCCACGAAGACCCTGAGGTCAAGTTCAACTGGTACGTGGACGGC
  181   ---------+---------+---------+---------+---------+---------+ 240
        CACCACCACCTGCACTCGGTGCTTCTGGGACTCCAGTTCAAGTTGACCATGCACCTGCCG
a        V  V  V  D  V  S  H  E  D  P  E  V  K  F  N  W  Y  V  D  G   -

GTGGAGGTGCATAATGCCAAGACAAAGCCGCGGGAGGAGCAGTACAACAGCACGTACCGT
  241   ---------+---------+---------+---------+---------+---------+ 300
        CACCTCCACGTATTACGGTTCTGTTTCGGCGCCCTCCTCGTCATGTTGTCGTGCATGGCA
a        V  E  V  H  N  A  K  T  K  P  R  E  E  Q  Y  N  S  T  Y  R   -

GTGGTCAGCGTCCTCACCGTCCTGCACCAGGACTGGCTGAATGGCAAGGAGTACAAGTGC
  301   ---------+---------+---------+---------+---------+---------+ 360
        CACCAGTCGCAGGAGTGGCAGGACGTGGTCCTGACCGACTTACCGTTCCTCATGTTCACG
a        V  V  S  V  L  T  V  L  H  Q  D  W  L  N  G  K  E  Y  K  C   -

AAGGTCTCCAACAAAGCCCTCCCAGCCCCCATCGAGAAAACCATCTCCAAAGCCAAAGGG
  361   ---------+---------+---------+---------+---------+---------+ 420
        TTCCAGAGGTTGTTTCGGGAGGGTCGGGGGTAGCTCTTTTGGTAGAGGTTTCGGTTTCCC
a        K  V  S  N  K  A  L  P  A  P  I  E  K  T  I  S  K  A  K  G   -

CAGCCCCGAGAACCACAGGTGTACACCCTGCCCCCATCCCGGGATGAGCTGACCAAGAAC
  421   ---------+---------+---------+---------+---------+---------+ 480
        GTCGGGGCTCTTGGTGTCCACATGTGGGACGGGGGTAGGGCCCTACTCGACTGGTTCTTG
a        Q  P  R  E  P  Q  V  Y  T  L  P  P  S  R  D  E  L  T  K  N   -

CAGGTCAGCCTGACCTGCCTGGTCAAAGGCTTCTATCCCAGCGACATCGCCGTGGAGTGG
  481   ---------+---------+---------+---------+---------+---------+ 540
        GTCCAGTCGGACTGGACGGACCAGTTTCCGAAGATAGGGTCGCTGTAGCGGCACCTCACC
a        Q  V  S  L  T  C  L  V  K  G  F  Y  P  S  D  I  A  V  E  W   -

GAGAGCAATGGGCAGCCGGAGAACAACTACAAGACCACGCCTCCCGTGCTGGACTCCGAC
  541   ---------+---------+---------+---------+---------+---------+ 600
        CTCTCGTTACCCGTCGGCCTCTTGTTGATGTTCTGGTGCGGAGGGCACGACCTGAGGCTG
a        E  S  N  G  Q  P  E  N  N  Y  K  T  T  P  P  V  L  D  S  D   -

GGCTCCTTCTTCCTCTACAGCAAGCTCACCGTGGACAAGAGCAGGTGGCAGCAGGGGAAC
  601   ---------+---------+---------+---------+---------+---------+ 660
        CCGAGGAAGAAGGAGATGTCGTTCGAGTGGCACCTGTTCTCGTCCACCGTCGTCCCCTTG
a        G  S  F  F  L  Y  S  K  L  T  V  D  K  S  R  W  Q  Q  G  N   -

GTCTTCTCATGCTCCGTGATGCATGAGGCTCTGCACAACCACTACACGCAGAAGAGCCTC
  661   ---------+---------+---------+---------+---------+---------+ 720
        CAGAAGAGTACGAGGCACTACGTACTCCGAGACGTGTTGGTGATGTGCGTCTTCTCGGAG
a        V  F  S  C  S  V  M  H  E  A  L  H  N  H  Y  T  Q  K  S  L   -
```

FIG. 15B

```
        TCCCTGTCTCCGGGTAAAGGAGGAGGAGGATCCGGAGGAGGAGGAAGCAGCTGCATCGAC
    721 ---------+---------+---------+---------+---------+---------+ 780
        AGGGACAGAGGCCCATTTCCTCCTCCTCCTAGGCCTCCTCCTCCTTCGTCGACGTAGCTG
a         S  L  S  P  G  K  G  G  G  G  S  G  G  G  G  S  S  C  I  D   -

ACCATCCCCAAGAGCCGCTGCACCGCCTTCCAGTGCAAGCACAGCATGAAGTACCGCCTG
    781 ---------+---------+---------+---------+---------+---------+ 840
        TGGTAGGGGTTCTCGGCGACGTGGCGGAAGGTCACGTTCGTGTCGTACTTCATGGCGGAC
a         T  I  P  K  S  R  C  T  A  F  Q  C  K  H  S  M  K  Y  R  L   -

AGCTTCTGCCGCAAGACCTGCGGCACCTGCTAA
    841 ---------+---------+---------+--- 873
        TCGAAGACGGCGTTCTGGACGCCGTGGACGATT
a         S  F  C  R  K  T  C  G  T  C  *   -
```

FIG. 16A

```
    ATGGAATGGAGCTGGGTCTTTCTCTTCTTCCTGTCAGTAACGACTGGTGTCCACTCCGAC
  1 ---------+---------+---------+---------+---------+---------+  60
    TACCTTACCTCGACCCAGAAAGAGAAGAAGGACAGTCATTGCTGACCACAGGTGAGGCTG
a   M  E  W  S  W  V  F  L  F  F  L  S  V  T  T  G  V  H  S  D   -

AAAACTCACACATGCCCACCGTGCCCAGCACCTGAACTCCTGGGGGGACCGTCAGTCTTC
 61 ---------+---------+---------+---------+---------+---------+ 120
    TTTTGAGTGTGTACGGGTGGCACGGGTCGTGGACTTGAGGACCCCCCTGGCAGTCAGAAG
a   K  T  H  T  C  P  P  C  P  A  P  E  L  L  G  G  P  S  V  F   -

CTCTTCCCCCCAAAACCCAAGGACACCCTCATGATCTCCCGGACCCCTGAGGTCACATGC
121 ---------+---------+---------+---------+---------+---------+ 180
    GAGAAGGGGGGTTTTGGGTTCCTGTGGGAGTACTAGAGGGCCTGGGGACTCCAGTGTACG
a   L  F  P  P  K  P  K  D  T  L  M  I  S  R  T  P  E  V  T  C   -

GTGGTGGTGGACGTGAGCCACGAAGACCCTGAGGTCAAGTTCAACTGGTACGTGGACGGC
181 ---------+---------+---------+---------+---------+---------+ 240
    CACCACCACCTGCACTCGGTGCTTCTGGGACTCCAGTTCAAGTTGACCATGCACCTGCCG
a   V  V  V  D  V  S  H  E  D  P  E  V  K  F  N  W  Y  V  D  G   -

GTGGAGGTGCATAATGCCAAGACAAAGCCGCGGGAGGAGCAGTACAACAGCACGTACCGT
241 ---------+---------+---------+---------+---------+---------+ 300
    CACCTCCACGTATTACGGTTCTGTTTCGGCGCCCTCCTCGTCATGTTGTCGTGCATGGCA
a   V  E  V  H  N  A  K  T  K  P  R  E  E  Q  Y  N  S  T  Y  R   -

GTGGTCAGCGTCCTCACCGTCCTGCACCAGGACTGGCTGAATGGCAAGGAGTACAAGTGC
301 ---------+---------+---------+---------+---------+---------+ 360
    CACCAGTCGCAGGAGTGGCAGGACGTGGTCCTGACCGACTTACCGTTCCTCATGTTCACG
a   V  V  S  V  L  T  V  L  H  Q  D  W  L  N  G  K  E  Y  K  C   -

AAGGTCTCCAACAAAGCCCTCCCAGCCCCCATCGAGAAAACCATCTCCAAAGCCAAAGGG
361 ---------+---------+---------+---------+---------+---------+ 420
    TTCCAGAGGTTGTTTCGGGAGGGTCGGGGGTAGCTCTTTTGGTAGAGGTTTCGGTTTCCC
a   K  V  S  N  K  A  L  P  A  P  I  E  K  T  I  S  K  A  K  G   -

CAGCCCCGAGAACCACAGGTGTACACCCTGCCCCCATCCCGGGATGAGCTGACCAAGAAC
421 ---------+---------+---------+---------+---------+---------+ 480
    GTCGGGGCTCTTGGTGTCCACATGTGGGACGGGGGTAGGGCCCTACTCGACTGGTTCTTG
a   Q  P  R  E  P  Q  V  Y  T  L  P  P  S  R  D  E  L  T  K  N   -

CAGGTCAGCCTGACCTGCCTGGTCAAAGGCTTCTATCCCAGCGACATCGCCGTGGAGTGG
481 ---------+---------+---------+---------+---------+---------+ 540
    GTCCAGTCGGACTGGACGGACCAGTTTCCGAAGATAGGGTCGCTGTAGCGGCACCTCACC
a   Q  V  S  L  T  C  L  V  K  G  F  Y  P  S  D  I  A  V  E  W   -

GAGAGCAATGGGCAGCCGGAGAACAACTACAAGACCACGCCTCCCGTGCTGGACTCCGAC
541 ---------+---------+---------+---------+---------+---------+ 600
    CTCTCGTTACCCGTCGGCCTCTTGTTGATGTTCTGGTGCGGAGGGCACGACCTGAGGCTG
a   E  S  N  G  Q  P  E  N  N  Y  K  T  T  P  P  V  L  D  S  D   -

GGCTCCTTCTTCCTCTACAGCAAGCTCACCGTGGACAAGAGCAGGTGGCAGCAGGGGAAC
601 ---------+---------+---------+---------+---------+---------+ 660
    CCGAGGAAGAAGGAGATGTCGTTCGAGTGGCACCTGTTCTCGTCCACCGTCGTCCCCTTG
a   G  S  F  F  L  Y  S  K  L  T  V  D  K  S  R  W  Q  Q  G  N   -

GTCTTCTCATGCTCCGTGATGCATGAGGCTCTGCACAACCACTACACGCAGAAGAGCCTC
661 ---------+---------+---------+---------+---------+---------+ 720
    CAGAAGAGTACGAGGCACTACGTACTCCGAGACGTGTTGGTGATGTGCGTCTTCTCGGAG
a   V  F  S  C  S  V  M  H  E  A  L  H  N  H  Y  T  Q  K  S  L   -
```

FIG. 16B

```
        TCCCTGTCTCCGGGTAAAGGAGGAGGAGGATCCGGGGGTGGGGGTTCTGGGGGTGGGGGT
    721 ---------+---------+---------+---------+---------+---------+ 780
        AGGGACAGAGGCCCATTTCCTCCTCCTCCTAGGCCCCCACCCCCAAGACCCCCACCCCCA
a       S   L   S   P   G   K   G   G   G   G   S   G   G   G   G   S   G   G   G   G    -
        TCTGGAGGAGGAGGAAGCGGAGGAGGAGGAAGCAGCTGCATCGACACCATCCCCAAGAGC
    781 ---------+---------+---------+---------+---------+---------+ 840
        AGACCTCCTCCTCCTTCGCCTCCTCCTCCTTCGTCGACGTAGCTGTGGTAGGGGTTCTCG
a       S   G   G   G   G   S   G   G   G   G   S   S   C   I   D   T   I   P   K   S    -
        CGCTGCACCGCCTTCCAGTGCAAGCACAGCATGAAGTACCGCCTGAGCTTCTGCCGCAAG
    841 ---------+---------+---------+---------+---------+---------+ 900
        GCGACGTGGCGGAAGGTCACGTTCGTGTCGTACTTCATGGCGGACTCGAAGACGGCGTTC
a       R   C   T   A   F   Q   C   K   H   S   M   K   Y   R   L   S   F   C   R   K    -
        ACCTGCGGCACCTGCTAA
    901 ---------+-------- 918
        TGGACGCCGTGGACGATT
a       T   C   G   T   C   *    -
```

A scheme for N-terminal PEGylation of ShK by reductive amination, which is also described in Example 32 hereinafter.

A scheme for N-terminal PEGylation of ShK via amide formation, which is also described in Example 34 hereinafter.

A scheme for N-terminal PEGylation of ShK by chemoselective oxime formation, which is also described in Example 33 hereinafter.

A scheme for N-terminal PEGylation of ShK by reductive amination, which is also described in Example 31 h SDS Page Legend
1. Molecular weight marker
2. 15ul of Fc-L-ShK
3. 10ul of Fc-L-ShK
4. 5ul of Fc-L-ShK
5. Molecular weight marker
6. Blank
7. 15ul of No DNA control
8. 10ul of No DNA control
9. 5ul of No DNA control
10. Molecular weight marker SDS Page Legend
1. blank
2. BB6
3. MWM
4. BB5
5. BB4
6. BB3
7. BB2
8. BB1
9. Blank
10. BD6
11. BD5
12. MWM
13. BD4
14. BD3
15. BD2

HEK 293 Untransfected Cells

HEK 293/hKv1.3 Transfected Cells

Level of Non-Specific Binding

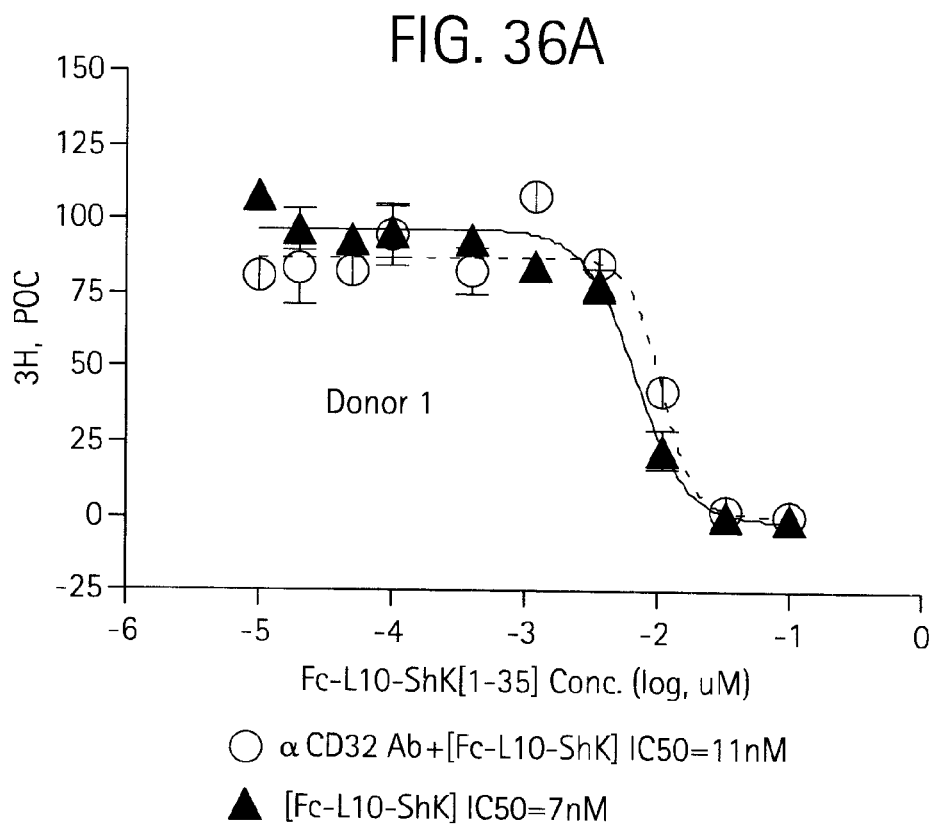
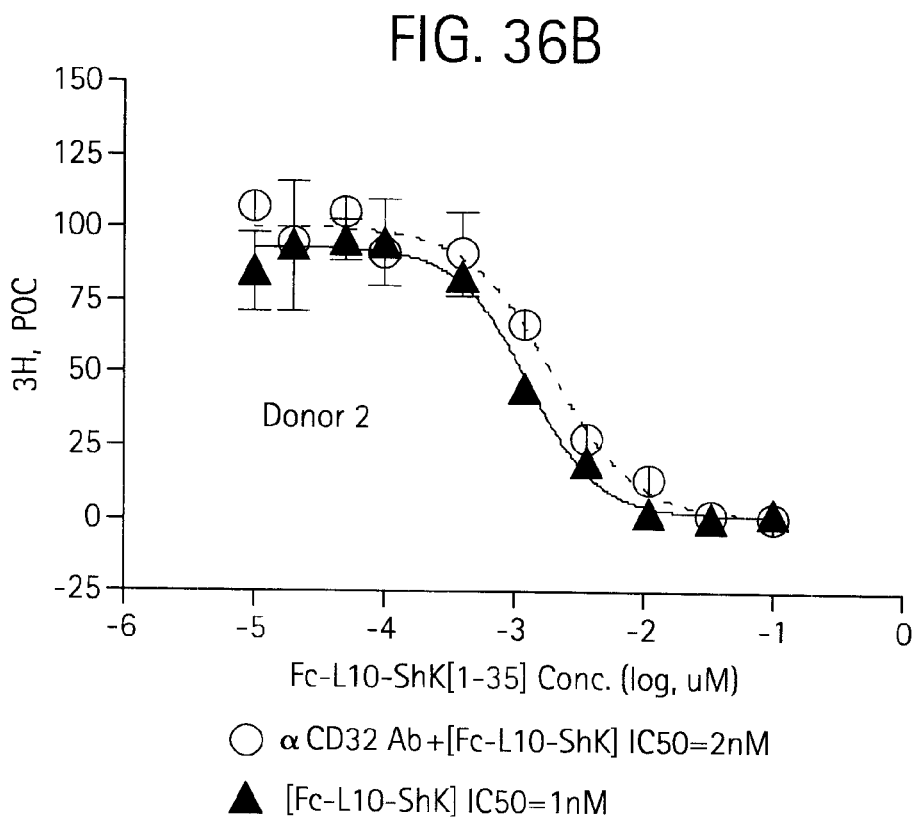

FIG. 42A

```
     atggaatggagctgggtctttctcttcttcctgtcagtaacgactggtgtccactccgac
  1  ---------+---------+---------+---------+---------+---------+  60
     taccttacctcgacccagaaagagaagaaggacagtcattgctgaccacaggtgaggctg
     M  E  W  S  W  V  F  L  F  F  L  S  V  T  T  G  V  H  S  D aaaactcacacatgcccaccgtgcccagcacctgaactcctggggggaccgtcagtcttc
 61  ---------+---------+---------+---------+---------+---------+ 120
     ttttgagtgtgtacgggtggcacgggtcgtggacttgaggacccccctggcagtcagaag
     K  T  H  T  C  P  P  C  P  A  P  E  L  L  G  G  P  S  V  F ctcttccccccaaaacccaaggacaccctcatgatctcccggacccctgaggtcacatgc
121  ---------+---------+---------+---------+---------+---------+ 180
     gagaaggggggttttgggttcctgtgggagtactagagggcctggggactccagtgtacg
     L  F  P  P  K  P  K  D  T  L  M  I  S  R  T  P  E  V  T  C gtggtggtggacgtgagccacgaagaccctgaggtcaagttcaactggtacgtggacggc
181  ---------+---------+---------+---------+---------+---------+ 240
     caccaccacctgcactcggtgcttctgggactccagttcaagttgaccatgcacctgccg
     V  V  V  D  V  S  H  E  D  P  E  V  K  F  N  W  Y  V  D  G gtggaggtgcataatgccaagacaaagccgcgggaggagcagtacaacagcacgtaccgt
241  ---------+---------+---------+---------+---------+---------+ 300
     cacctccacgtattacggttctgtttcggcgccctcctcgtcatgttgtcgtgcatggca
     V  E  V  H  N  A  K  T  K  P  R  E  E  Q  Y  N  S  T  Y  R gtggtcagcgtcctcaccgtcctgcaccaggactggctgaatggcaaggagtacaagtgc
301  ---------+---------+---------+---------+---------+---------+ 360
     caccagtcgcaggagtggcaggacgtggtcctgaccgacttaccgttcctcatgttcacg
     V  V  S  V  L  T  V  L  H  Q  D  W  L  N  G  K  E  Y  K  C aaggtctccaacaaagccctcccagcccccatcgagaaaaccatctccaaagccaaaggg
361  ---------+---------+---------+---------+---------+---------+ 420
     ttccagaggttgtttcgggagggtcggggggtagctcttttggtagaggtttcggtttccc
     K  V  S  N  K  A  L  P  A  P  I  E  K  T  I  S  K  A  K  G cagccccgagaaccacaggtgtacaccctgcccccatcccgggatgagctgaccaagaac
421  ---------+---------+---------+---------+---------+---------+ 480
     gtcggggctcttggtgtccacatgtgggacggggtagggccctactcgactggttcttg
     Q  P  R  E  P  Q  V  Y  T  L  P  P  S  R  D  E  L  T  K  N caggtcagcctgacctgcctggtcaaaggcttctatcccagcgacatcgccgtggagtgg
481  ---------+---------+---------+---------+---------+---------+ 540
     gtccagtcggactggacggaccagtttccgaagatagggtcgctgtagcggcacctcacc
     Q  V  S  L  T  C  L  V  K  G  F  Y  P  S  D  I  A  V  E  W gagagcaatgggcagccggagaacaactacaagaccacgcctcccgtgctggactccgac
541  ---------+---------+---------+---------+---------+---------+ 600
     ctctcgttacccgtcggcctcttgttgatgttctggtgcggagggcacgacctgaggctg
     E  S  N  G  Q  P  E  N  N  Y  K  T  T  P  P  V  L  D  S  D
```

FIG. 42B

```
      ggctccttcttcctctacagcaagctcaccgtggacaagagcaggtggcagcaggggaac
601   ---------+---------+---------+---------+---------+---------+  660
      ccgaggaagaaggagatgtcgttcgagtggcacctgttctcgtccaccgtcgtccccttg
      G  S  F  F  L  Y  S  K  L  T  V  D  K  S  R  W  Q  Q  G  N gtcttctcatgctccgtgatgcatgaggctctgcacaaccactacacgcagaagagcctc
661   ---------+---------+---------+---------+---------+---------+  720
      cagaagagtacgaggcactacgtactccgagacgtgttggtgatgtgcgtcttctcggag
      V  F  S  C  S  V  M  H  E  A  L  H  N  H  Y  T  Q  K  S  L tccctgtctccgggtaaaggaggaggaggatccggaggaggaggaagcggcgtgatcatc
721   ---------+---------+---------+---------+---------+---------+  780
      agggacagaggcccatttcctcctcctcctaggcctcctcctccttcgccgcactagtag
      S  L  S  P  G  K  G  G  G  S  G  G  G  S  G  V  I  I aacgtgaagtgcaagatcagccgccagtgcctggagccctgcaagaaggccggcatgcgc
781   ---------+---------+---------+---------+---------+---------+  840
      ttgcacttcacgttctagtcggcggtcacggacctcgggacgttcttccggccgtacgcg
      N  V  K  C  K  I  S  R  Q  C  L  E  P  C  K  K  A  G  M  R ttcggcaagtgcatgaacggcaagtgccactgcacccccaagtagtaa
841   ---------+---------+---------+---------+--------  888
      aagccgttcacgtacttgccgttcacggtgacgtggggggttcatcatt
      F  G  K  C  M  N  G  K  C  H  C  T  P  K  *  *
```

FIG. 43A

```
    atggaatggagctgggtctttctcttcttcctgtcagtaacgactggtgtccactccgac
  1 ---------+---------+---------+---------+---------+---------+ 60
    taccttacctcgacccagaaagagaagaaggacagtcattgctgaccacaggtgaggctg
    M  E  W  S  W  V  F  L  F  F  L  S  V  T  T  G  V  H  S  D aaaactcacacatgcccaccgtgcccagcacctgaactcctggggggaccgtcagtcttc
 61 ---------+---------+---------+---------+---------+---------+ 120
    ttttgagtgtgtacgggtggcacgggtcgtggacttgaggacccccctggcagtcagaag
    K  T  H  T  C  P  P  C  P  A  P  E  L  L  G  G  P  S  V  F ctcttccccccaaaacccaaggacaccctcatgatctcccggacccctgaggtcacatgc
121 ---------+---------+---------+---------+---------+---------+ 180
    gagaaggggggttttgggttcctgtgggagtactagagggcctggggactccagtgtacg
    L  F  P  P  K  P  K  D  T  L  M  I  S  R  T  P  E  V  T  C gtggtggtggacgtgagccacgaagaccctgaggtcaagttcaactggtacgtggacggc
181 ---------+---------+---------+---------+---------+---------+ 240
    caccaccacctgcactcggtgcttctgggactccagttcaagttgaccatgcacctgccg
    V  V  V  D  V  S  H  E  D  P  E  V  K  F  N  W  Y  V  D  G gtggaggtgcataatgccaagacaaagccgcgggaggagcagtacaacagcacgtaccgt
241 ---------+---------+---------+---------+---------+---------+ 300
    cacctccacgtattacggttctgtttcggcgccctcctcgtcatgttgtcgtgcatggca
    V  E  V  H  N  A  K  T  K  P  R  E  E  Q  Y  N  S  T  Y  R gtggtcagcgtcctcaccgtcctgcaccaggactggctgaatggcaaggagtacaagtgc
301 ---------+---------+---------+---------+---------+---------+ 360
    caccagtcgcaggagtggcaggacgtggtcctgaccgacttaccgttcctcatgttcacg
    V  V  S  V  L  T  V  L  H  Q  D  W  L  N  G  K  E  Y  K  C aaggtctccaacaaagccctcccagcccccatcgagaaaaccatctccaaagccaaaggg
361 ---------+---------+---------+---------+---------+---------+ 420
    ttccagaggttgtttcgggagggtcgggggtagctcttttggtagaggtttcggtttccc
    K  V  S  N  K  A  L  P  A  P  I  E  K  T  I  S  K  A  K  G cagccccgagaaccacaggtgtacaccctgcccccatcccgggatgagctgaccaagaac
421 ---------+---------+---------+---------+---------+---------+ 480
    gtcggggctcttggtgtccacatgtgggacgggggtagggccctactcgactggttcttg
    Q  P  R  E  P  Q  V  Y  T  L  P  P  S  R  D  E  L  T  K  N caggtcagcctgacctgcctggtcaaaggcttctatcccagcgacatcgccgtggagtgg
481 ---------+---------+---------+---------+---------+---------+ 540
    gtccagtcggactggacggaccagtttccgaagatagggtcgctgtagcggcacctcacc
    Q  V  S  L  T  C  L  V  K  G  F  Y  P  S  D  I  A  V  E  W gagagcaatgggcagccggagaacaactacaagaccacgcctcccgtgctggactccgac
541 ---------+---------+---------+---------+---------+---------+ 600
    ctctcgttacccgtcggcctcttgttgatgttctggtgcggagggcacgacctgaggctg
    E  S  N  G  Q  P  E  N  N  Y  K  T  T  P  P  V  L  D  S  D
```

FIG. 43B

```
    ggctccttcttcctctacagcaagctcaccgtggacaagagcaggtggcagcagggaac
601 ---------+---------+---------+---------+---------+---------+ 660
    ccgaggaagaaggagatgtcgttcgagtggcacctgttctcgtccaccgtcgtcccttg
     G  S  F  F  L  Y  S  K  L  T  V  D  K  S  R  W  Q  Q  G  N gtcttctcatgctccgtgatgcatgaggctctgcacaaccactacacgcagaagagcctc
661 ---------+---------+---------+---------+---------+---------+ 720
    cagaagagtacgaggcactacgtactccgagacgtgttggtgatgtgcgtcttctcggag
     V  F  S  C  S  V  M  H  E  A  L  H  N  H  Y  T  Q  K  S  L tccctgtctccgggtaaaggaggaggaggatccggaggaggaggaagcggcgtgatcatc
721 ---------+---------+---------+---------+---------+---------+ 780
    agggacagaggcccatttcctcctcctcctaggcctcctcctccttcgccgcactagtag
     S  L  S  P  G  K  G  G  G  S  G  G  G  G  S  G  V  I  I aacgtgagctgcaagatcagccgccagtgcctggagccctgcaagaaggccggcatgcgc
781 ---------+---------+---------+---------+---------+---------+ 840
    ttgcactcgacgttctagtcggcggtcacggacctcgggacgttcttccggccgtacgcg
     N  V  S  C  K  I  S  R  Q  C  L  E  P  C  K  K  A  G  M  R ttcggcaagtgcatgaacggcaagtgccactgcaccccaagtagtaa
841 ---------+---------+---------+---------+-------- 888
    aagccgttcacgtacttgccgttcacggtgacgtggggttcatcatt
     F  G  K  C  M  N  G  K  C  H  C  T  P  K  *  *
```

FIG. 44A

```
     atggaatggagctgggtctttctcttcttcctgtcagtaacgactggtgtccactccgac
  1  ------------+---------+---------+---------+---------+---------+  60
     taccttacctcgacccagaaagagaagaaggacagtcattgctgaccacaggtgaggctg
      M  E  W  S  W  V  F  L  F  F  L  S  V  T  T  G  V  H  S  D aaaactcacacatgcccaccgtgcccagcacctgaactcctggggggaccgtcagtcttc
 61  ---------+---------+---------+---------+---------+---------+ 120
     ttttgagtgtgtacgggtggcacgggtcgtggacttgaggacccccctggcagtcagaag
      K  T  H  T  C  P  P  C  P  A  P  E  L  L  G  G  P  S  V  F ctcttccccccaaaacccaaggacaccctcatgatctcccggacccctgaggtcacatgc
121  ---------+---------+---------+---------+---------+---------+ 180
     gagaaggggggttttgggttcctgtgggagtactagagggcctgggactccagtgtacg
      L  F  P  P  K  P  K  D  T  L  M  I  S  R  T  P  E  V  T  C gtggtggtggacgtgagccacgaagaccctgaggtcaagttcaactggtacgtggacggc
181  ---------+---------+---------+---------+---------+---------+ 240
     caccaccacctgcactcggtgcttctgggactccagttcaagttgaccatgcacctgccg
      V  V  V  D  V  S  H  E  D  P  E  V  K  F  N  W  Y  V  D  G gtggaggtgcataatgccaagacaaagccgcgggaggagcagtacaacagcacgtaccgt
241  ---------+---------+---------+---------+---------+---------+ 300
     cacctccacgtattacggttctgtttcggcgccctcctcgtcatgttgtcgtgcatggca
      V  E  V  H  N  A  K  T  K  P  R  E  E  Q  Y  N  S  T  Y  R gtggtcagcgtcctcaccgtcctgcaccaggactggctgaatggcaaggagtacaagtgc
301  ---------+---------+---------+---------+---------+---------+ 360
     caccagtcgcaggagtggcaggacgtggtcctgaccgacttaccgttcctcatgttcacg
      V  V  S  V  L  T  V  L  H  Q  D  W  L  N  G  K  E  Y  K  C aaggtctccaacaaagccctcccagcccccatcgagaaaaccatctccaaagccaaaggg
361  ---------+---------+---------+---------+---------+---------+ 420
     ttccagaggttgtttcgggagggtcgggggtagctcttttggtagaggtttcggtttccc
      K  V  S  N  K  A  L  P  A  P  I  E  K  T  I  S  K  A  K  G cagccccgagaaccacaggtgtacaccctgcccccatcccgggatgagctgaccaagaac
421  ---------+---------+---------+---------+---------+---------+ 480
     gtcggggctcttggtgtccacatgtgggacgggggtagggccctactcgactggttcttg
      Q  P  R  E  P  Q  V  Y  T  L  P  P  S  R  D  E  L  T  K  N caggtcagcctgacctgcctggtcaaaggcttctatcccagcgacatcgccgtggagtgg
481  ---------+---------+---------+---------+---------+---------+ 540
     gtccagtcggactggacggaccagtttccgaagataggtcgctgtagcggcacctcacc
      Q  V  S  L  T  C  L  V  K  G  F  Y  P  S  D  I  A  V  E  W gagagcaatgggcagccggagaacaactacaagaccacgcctcccgtgctggactccgac
541  ---------+---------+---------+---------+---------+---------+ 600
     ctctcgttacccgtcggcctcttgttgatgttctggtgcggagggcacgacctgaggctg
      E  S  N  G  Q  P  E  N  N  Y  K  T  T  P  P  V  L  D  S  D
```

FIG. 44B

```
        ggctccttcttcctctacagcaagctcaccgtggacaagagcaggtggcagcagggaac
601     ---------+---------+---------+---------+---------+---------+ 660
        ccgaggaagaaggagatgtcgttcgagtggcacctgttctcgtccaccgtcgtccccttg
         G  S  F  F  L  Y  S  K  L  T  V  D  K  S  R  W  Q  Q  G  N gtcttctcatgctccgtgatgcatgaggctctgcacaaccactacacgcagaagagcctc
661     ---------+---------+---------+---------+---------+---------+ 720
        cagaagagtacgaggcactacgtactccgagacgtgttggtgatgtgcgtcttctcggag
         V  F  S  C  S  V  M  H  E  A  L  H  N  H  Y  T  Q  K  S  L tccctgtctccgggtaaaggaggaggaggatccggaggaggaggaagcggcgtgatcatc
721     ---------+---------+---------+---------+---------+---------+ 780
        agggacagaggcccatttcctcctcctcctaggcctcctcctccttcgccgcactagtag
         S  L  S  P  G  K  G  G  G  G  S  G  G  G  G  S  G  V  I  I aacgtgaagtgcaagatcagccgccagtgcctgaagccctgcaaggacgccggcatgcgc
781     ---------+---------+---------+---------+---------+---------+ 840
        ttgcacttcacgttctagtcggcggtcacggacttcgggacgttcctgcggccgtacgcg
         N  V  K  C  K  I  S  R  Q  C  L  K  P  C  K  D  A  G  M  R ttcggcaagtgcatgaacggcaagtgccactgcacccccaagtagtaa
841     ---------+---------+---------+---------+-------- 888
        aagccgttcacgtacttgccgttcacggtgacgtggggttcatcatt
         F  G  K  C  M  N  G  K  C  H  C  T  P  K  *  *
```

FIG. 45A

```
    atggaatggagctgggtctttctcttcttcctgtcagtaacgactggtgtccactccgac
1   ---------+---------+---------+---------+---------+---------+ 60
    taccttacctcgacccagaaagagaagaaggacagtcattgctgaccacaggtgaggctg
    M  E  W  S  W  V  F  L  F  F  L  S  V  T  T  G  V  H  S  D aaaactcacacatgcccaccgtgcccagcacctgaactcctggggggaccgtcagtcttc
61  ---------+---------+---------+---------+---------+---------+ 120
    ttttgagtgtgtacgggtggcacgggtcgtggacttgaggacccccctggcagtcagaag
    K  T  H  T  C  P  P  C  P  A  P  E  L  L  G  G  P  S  V  F ctcttcccccaaaacccaaggacaccctcatgatctcccggacccctgaggtcacatgc
121 ---------+---------+---------+---------+---------+---------+ 180
    gagaagggggttttgggttcctgtgggagtactagagggcctgggactccagtgtacg
    L  F  P  P  K  P  K  D  T  L  M  I  S  R  T  P  E  V  T  C gtggtggtggacgtgagccacgaagaccctgaggtcaagttcaactggtacgtggacggc
181 ---------+---------+---------+---------+---------+---------+ 240
    caccaccacctgcactcggtgcttctgggactccagttcaagttgaccatgcacctgccg
    V  V  V  D  V  S  H  E  D  P  E  V  K  F  N  W  Y  V  D  G gtggaggtgcataatgccaagacaaagccgcgggaggagcagtacaacagcacgtaccgt
241 ---------+---------+---------+---------+---------+---------+ 300
    cacctccacgtattacggttctgtttcggcgccctcctcgtcatgttgtcgtgcatggca
    V  E  V  H  N  A  K  T  K  P  R  E  E  Q  Y  N  S  T  Y  R gtggtcagcgtcctcaccgtcctgcaccaggactggctgaatggcaaggagtacaagtgc
301 ---------+---------+---------+---------+---------+---------+ 360
    caccagtcgcaggagtggcaggacgtggtcctgaccgacttaccgttcctcatgttcacg
    V  V  S  V  L  T  V  L  H  Q  D  W  L  N  G  K  E  Y  K  C aaggtctccaacaaagccctcccagcccccatcgagaaaaccatctccaaagccaaaggg
361 ---------+---------+---------+---------+---------+---------+ 420
    ttccagaggttgtttcgggagggtcgggggtagctcttttggtagaggtttcggtttccc
    K  V  S  N  K  A  L  P  A  P  I  E  K  T  I  S  K  A  K  G cagccccgagaaccacaggtgtacaccctgcccccatcccgggatgagctgaccaagaac
421 ---------+---------+---------+---------+---------+---------+ 480
    gtcggggctcttggtgtccacatgtgggacggggtagggccctactcgactggttcttg
    Q  P  R  E  P  Q  V  Y  T  L  P  P  S  R  D  E  L  T  K  N caggtcagcctgacctgcctggtcaaaggcttctatcccagcgacatcgccgtggagtgg
481 ---------+---------+---------+---------+---------+---------+ 540
    gtccagtcggactggacggaccagtttccgaagataggggtcgctgtagcggcacctcacc
    Q  V  S  L  T  C  L  V  K  G  F  Y  P  S  D  I  A  V  E  W gagagcaatgggcagccggagaacaactacaagaccacgcctcccgtgctggactccgac
541 ---------+---------+---------+---------+---------+---------+ 600
    ctctcgttacccgtcggcctcttgttgatgttctggtgcggagggcacgacctgaggctg
    E  S  N  G  Q  P  E  N  N  Y  K  T  T  P  P  V  L  D  S  D
```

FIG. 45B

```
    ggctccttcttcctctacagcaagctcaccgtggacaagagcaggtggcagcagggaac
601 ---------+---------+---------+---------+---------+---------+ 660
    ccgaggaagaaggagatgtcgttcgagtggcacctgttctcgtccaccgtcgtccccttg
     G  S  F  F  L  Y  S  K  L  T  V  D  K  S  R  W  Q  Q  G  N gtcttctcatgctccgtgatgcatgaggctctgcacaaccactacacgcagaagagcctc
661 ---------+---------+---------+---------+---------+---------+ 720
    cagaagagtacgaggcactacgtactccgagacgtgttggtgatgtgcgtcttctcggag
     V  F  S  C  S  V  M  H  E  A  L  H  N  H  Y  T  Q  K  S  L tccctgtctccgggtaaaggaggaggaggatccggaggaggaggaagcggcgtgatcatc
721 ---------+---------+---------+---------+---------+---------+ 780
    agggacagaggcccatttcctcctcctcctaggcctcctcctccttcgccgcactagtag
     S  L  S  P  G  K  G  G  G  G  S  G  G  G  G  S  G  V  I  I aacgtgagctgcaagatcagccgccagtgcctgaagccctgcaaggacgccggcatgcgc
781 ---------+---------+---------+---------+---------+---------+ 840
    ttgcactcgacgttctagtcggcggtcacggacttcgggacgttcctgcggccgtacgcg
     N  V  S  C  K  I  S  R  Q  C  L  K  P  C  K  D  A  G  M  R ttcggcaagtgcatgaacggcaagtgccactgcacccccaagtagtaa
841 ---------+---------+---------+---------+-------- 888
    aagccgttcacgtacttgccgttcacggtgacgtgggggttcatcatt
     F  G  K  C  M  N  G  K  C  H  C  T  P  K  *  *
```

▽ 20K PEG-ShK[1-35] (rat#10)

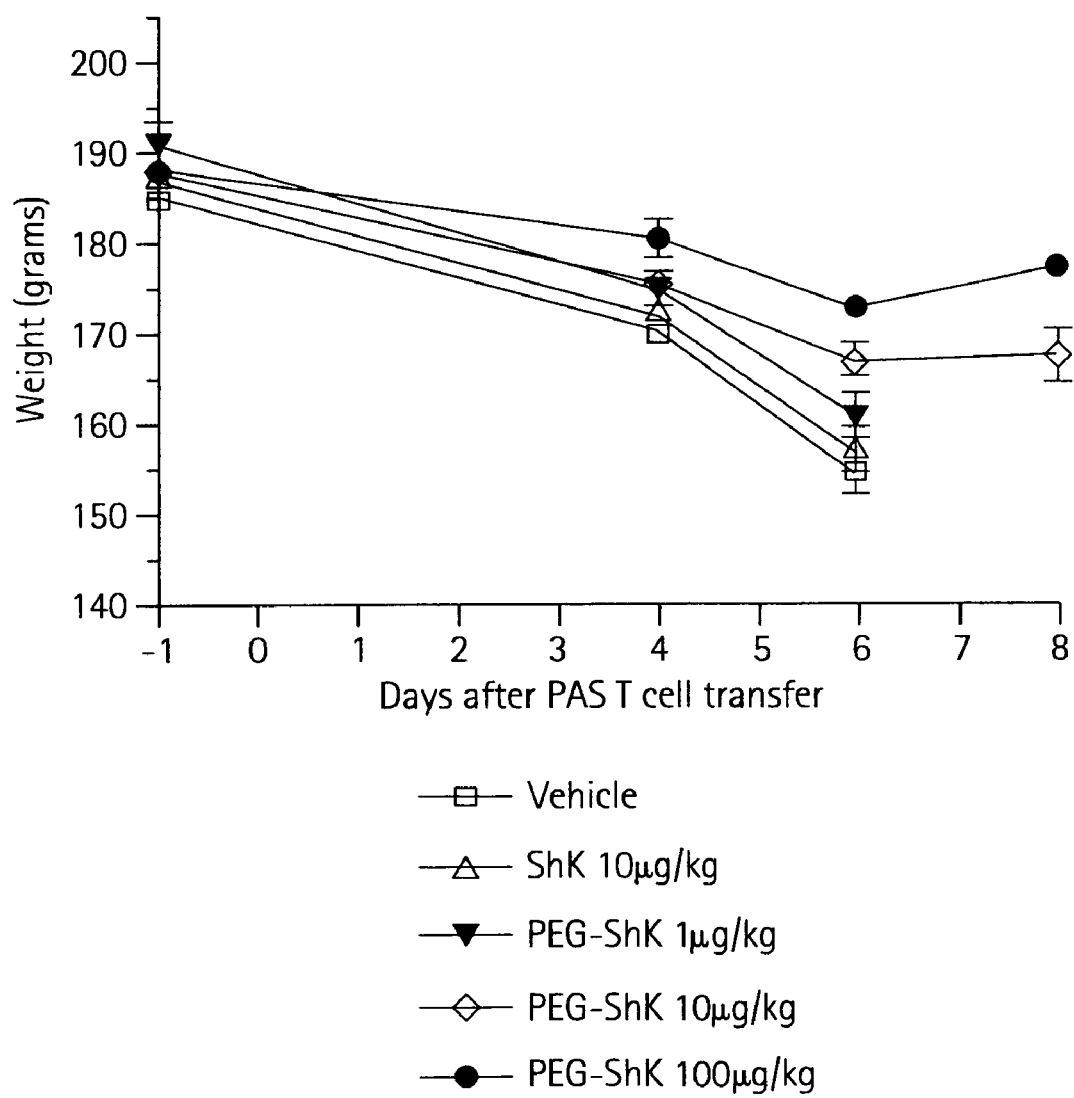

FIG. 70

```
  1  mdkthtcppc papellggps vflfppkpkd tlmisrtpev tcvvvdvshe
 51  dpevkfnwyv dgvevhnakt kpreeqynst yrvvsvltvl hqdwlngkey
101  kckvsnkalp apiektiska kgqprepqvy tlppsrdelg ggviinvkck
151  isrqclepck kagmrfgkcm ngkchctpkg gtknqvsltc lvkgfypsdi
201  avewesngqp ennykttppv ldsdgsffly skltvdksrw qqgnvfscsv
251  mhealhnhyt qkslslspgk
```

FIG. 71

```
  1  mdkthtcppc papellggps vflfppkpkd tlmisrtpev tcvvvdvshe
 51  dpevkfnwyv dgvevhnakt kpreeqynst yrvvsvltvl hqdwlngkey
101  kckvsnkalp apiektiska kgqprepqvy tlppsrdelg grscidtipk
151  srctafqckh smkyrlsfcr ktcgtcggtk nqvsltclvk gfypsdiave
201  wesngqpenn ykttppvlds dgsfflyskl tvdksrwqqg nvfscsvmhe
251  alhnhytqks lslspgk
```

FIG. 72

```
  1  mdkthtcppc papellggps vflfppkpkd tlmisrtpev tcvvvdvshe
 51  dpevkfnwyv dgvevhnakt kpreeqynst yrvvsvltvl hqdwlngkey
101  kckvsnkalp apiektiska kgqprepqvy tlppsrdelg grscidtipk
151  srctafqckh smkyrlsfcr ktcgtcgggg tknqvsltcl vkgfypsdia
201  vewesngqpe nnykttppvl dsdgsfflys kltvdksrwq qgnvfscsvm
251  healhnhytq kslslspgk
```

FIG. 73

```
  1  mdkthtcppc papellggps vflfppkpkd tlmisrtpev tcvvvdvshe
 51  dpevkfnwyv dgvevhnakt kpreeqynst yrvvsvltvl hqdwlngkey
101  kckvsnkalp apiektiska kgqprepqvy tlppsrdelg ggggviinvk
151  ckisrqclep ckkagmrfgk cmngkchctp kggtknqvsl tclvkgfyps
201  diavewesng qpennykttp pvldsdgsff lyskltvdks rwqqgnvfsc
251  svmhealhnh ytqkslslsp gk
```

FIG. 75A     FIG. 75B     FIG. 75C     FIG. 75D
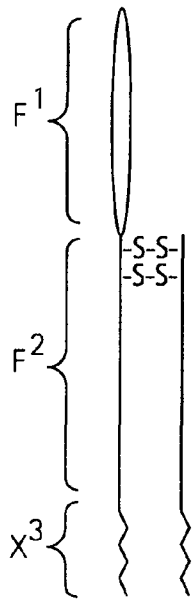
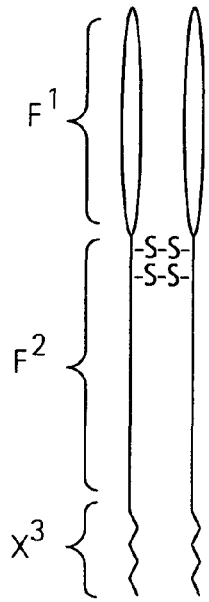
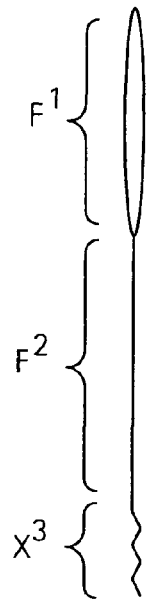
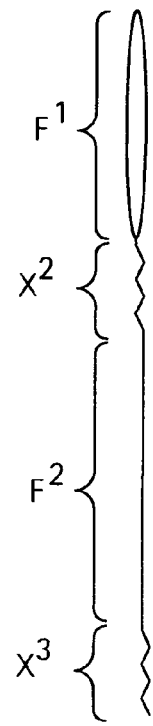
FIG. 75E     FIG. 75F     FIG. 75G     FIG. 75H
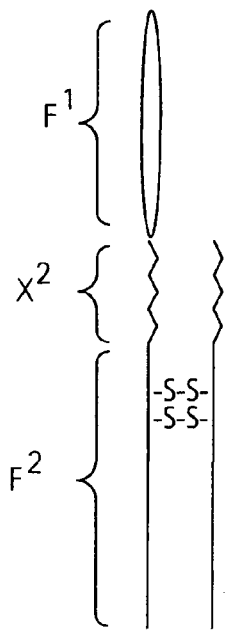
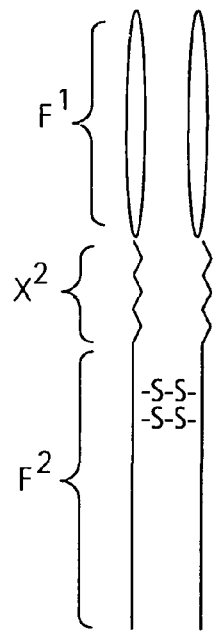
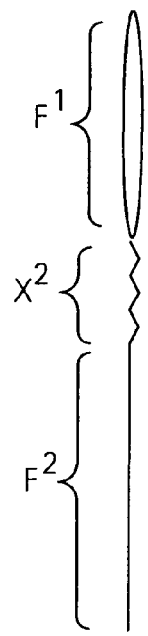
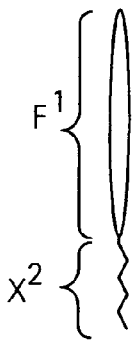

— Det 166
Met-Shk

TOXIN PEPTIDE THERAPEUTIC AGENTS

This application claims the benefit of U.S. Provisional Application No. 60/672,342, filed Apr. 22, 2005, which is hereby incorporated by reference.

This application incorporates by reference all subject matter contained on the compact disc, which is identified by the name of the file, A-1006.ST25.txt created on Apr. 17, 2006, the size of which file is 744 KB.

Throughout this application various publications are referenced within parentheses or brackets. The disclosures of these publications in their entireties are hereby incorporated by reference in this application in order to more fully describe the state of the art to which this invention pertains.

BACKGROUND OF THE INVENTION

1. Field of the Invention

The present invention is related to the biochemical arts, in particular to therapeutic peptides and conjugates.

2. Discussion of the Related Art

Ion channels are a diverse group of molecules that permit the exchange of small inorganic ions across membranes. All cells require ion channels for function, but this is especially so for excitable cells such as those present in the nervous system and the heart. The electrical signals orchestrated by ion channels control the thinking brain, the beating heart and the contracting muscle. Ion channels play a role in regulating cell volume, and they control a wide variety of signaling processes.

The ion channel family includes $Na^+$, $K^+$, and $Ca^{2+}$ cation and $Cl^-$ anion channels. Collectively, ion channels are distinguished as either ligand-gated or voltage-gated. Ligand-gated channels include both extracellular and intracellular ligand-gated channels. The extracellular ligand-gated channels include the nicotinic acetylcholine receptor (nAChR), the serotonin (5-hdroxytryptamine, 5-HT) receptors, the glycine and γ-butyric acid receptors (GABA) and the glutamate-activated channels including kanate, α-amino-3-hydroxy-5-methyl-4-isoxazole propionic acid (AMPA) and N-methyl-D-aspartate receptors (NMDA) receptors. (Harte and Ouzounis (2002), *FEBS Lett.* 514: 129-34). Intracellular ligand gated channels include those activated by cyclic nucleotides (e.g. cAMP, cGMP), $Ca^{2+}$ and G-proteins. (Harte and Ouzounis (2002), *FEBS Lett.* 514: 129-34). The voltage-gated ion channels are categorized by their selectivity for inorganic ion species, including sodium, potassium, calcium and chloride ion channels. (Harte and Ouzounis (2002), *FEBS Lett.* 514: 129-34).

A unified nomenclature for classification of voltage-gated channels was recently presented. (Catterall et al. (2000), *Pharmacol. Rev.* 55: 573-4; Gutman et al. (2000), *Pharmacol. Rev.* 55, 583-6; Catterall et al. (2000) *Pharmacol. Rev.* 55: 579-81; Catterall et al. (2000), *Pharmacol. Rev.* 55: 575-8; Hofmann et al. (2000), *Pharmacol. Rev.* 55: 587-9; Clapham et al. (2000), *Pharmacol Rev.* 55: 591-6; Chandy (1991), *Nature* 352: 26; Goldin et al. (2000), *Neuron* 28: 365-8; Ertel et al. (2000), *Neuron* 25: 533-5).

The $K^+$ channels constitute the largest and best characterized family of ion channels described to date. Potassium channels are subdivided into three general groups: the 6 transmembrane (6TM) $K^+$ channels, the 2TM-2TM/leak $K^+$ channels and the 2TM/Kir inward rectifying channels. (Tang et al. (2004), *Ann. Rev. Physiol.* 66, 131-159). These three groups are further subdivided into families based on sequence similarity. The voltage-gated $K^+$ channels, including (Kv1-6, Kv8-9), EAG, KQT, and Slo (BKCa), are family members of the 6TM group. The 2TM-2TM group comprises TWIK, TREK, TASK, TRAAK, and THIK, whereas the 2TM/Kir group consists of Kir1-7. Two additional classes of ion channels include the inward rectifier potassium (IRK) and ATP-gated purinergic (P2X) channels. (Harte and Ouzounis (2002), *FEBS Lett.* 514: 129-34).

Toxin peptides produced by a variety of organisms have evolved to target ion channels. Snakes, scorpions, spiders, bees, snails and sea anemone are a few examples of organisms that produce venom that can serve as a rich source of small bioactive toxin peptides or "toxins" that potently and selectively target ion channels and receptors. In most cases, these toxin peptides have evolved as potent antagonists or inhibitors of ion channels, by binding to the channel pore and physically blocking the ion conduction pathway. In some other cases, as with some of the tarantula toxin peptides, the peptide is found to antagonize channel function by binding to a region outside the pore (e.g., the voltage sensor domain).

The toxin peptides are usually between about 20 and about 80 amino acids in length, contain 2-5 disulfide linkages and form a very compact structure (see, e.g., FIG. 10). Toxin peptides (e.g., from the venom of scorpions, sea anemones and cone snails) have been isolated and characterized for their impact on ion channels. Such peptides appear to have evolved from a relatively small number of structural frameworks that are particularly well suited to addressing the critical issues of potency and stability. The majority of scorpion and *Conus* toxin peptides, for example, contain 10-40 amino acids and up to five disulfide bonds, forming extremely compact and constrained structure (microproteins) often resistant to proteolysis. The conotoxin and scorpion toxin peptides can be divided into a number of superfamilies based on their disulfide connections and peptide folds. The solution structure of many of these has been determined by NMR spectroscopy, illustrating their compact structure and verifying conservation of their family fold. (E.g., Tudor et al., Ionisation behaviour and solution properties of the potassium-channel blocker ShK toxin, Eur. J. Biochem. 251(1-2):133-41(1998); Pennington et al., Role of disulfide bonds in the structure and potassium channel blocking activity of ShK toxin, Biochem. 38(44): 14549-58 (1999); Jaravine et al., Three-dimensional structure of toxin OSK1 from Orthochirus scrobiculosus scorpion venom, Biochem. 36(6):1223-32 (1997); del Rio-Portillo et al.; NMR solution structure of Cn12, a novel peptide from the Mexican scorpion Centruroides noxius with a typical beta-toxin sequence but with alpha-like physiological activity, Eur. J. Biochem. 271(12): 2504-16 (2004); Prochnicka-Chalufour et al., Solution structure of discrepin, a new K+-channel blocking peptide from the alpha-KTx15 subfamily, Biochem. 45(6):1795-1804 (2006)).

Conserved disulfide structures can also reflect the individual pharmacological activity of the toxin family. (Nicke et al. (2004), *Eur. J. Biochem.* 271: 2305-19, Table 1; Adams (1999), *Drug Develop. Res.* 46: 219-34). For example, α-conotoxins have well-defined four cysteine/two disulfide loop structures (Loughnan, 2004) and inhibit nicotinic acetylcholine receptors. In contrast, ω-conotoxins have six cysteine/three disulfide loop consensus structures (Nielsen, 2000) and block calcium channels. Structural subsets of toxins have evolved to inhibit either voltage-gated or calcium-activated potassium channels. FIG. 9 shows that a limited number of conserved disulfide architectures shared by a variety of venomous animals from bee to snail and scorpion to snake target ion channels. FIG. 7 shows alignment of alpha-scorpion toxin family and illustrates that a conserved structural framework is used to derive toxins targeting a vast array of potassium channels.

Due to their potent and selective blockade of specific ion channels, toxin peptides have been used for many years as tools to investigate the pharmacology of ion channels. Other than excitable cells and tissues such as those present in heart, muscle and brain, ion channels are also important to non-excitable cells such as immune cells. Accordingly, the potential therapeutic utility of toxin peptides has been considered for treating various immune disorders, in particular by inhibition of potassium channels such as Kv1.3 and IKCa1 since these channels indirectly control calcium signaling pathway in lymphocytes. [e.g., Kem et al., ShK toxin compositions and methods of use, U.S. Pat. No. 6,077,680; Lebrun et al., Neuropeptides originating in scorpion, U.S. Pat. No. 6,689,749; Beeton et al., Targeting effector memory T cells with a selective peptide inhibitor of Kv1.3 channnels for therapy of autoimmune diseases, Molec. Pharmacol. 67(4):1369-81 (2005); Mouhat et al., $K^+$ channel types targeted by synthetic OSK1, a toxin from Orthochirus scrobiculosus scorpion venom, Biochem. J. 385:95-104 (2005); Mouhat et al., Pharmacological profiling of Orthochirus scrobiculosus toxin 1 analogs with a trimmed N-terminal domain, Molec. Pharmacol. 69:354-62 (2006); Mouhat et al., OsK1 derivatives, WO 2006/002850 A2; B. S. Jensen et al. The $Ca^{2+}$-activated K+ Channel of Intermediate Conductance: A Molecular Target for Novel Treatments?, Current Drug Targets 2:401-422 (2001); Rauer et al., Structure-guided Transformation of Charybdotoxin Yields an Analog That Selectively Targets $Ca^{2+}$-activated over Voltage-gated $K^+$ Channels, J. Biol. Chem. 275: 1201-1208 (2000); Castle et al., Maurotoxin: A Potent Inhibitor of Intermediate Conductance $Ca^{2+}$-Activated Potassium Channels, Molecular Pharmacol. 63: 409-418 (2003); Chandy et al., $K^+$ channels as targets for specific Immunomodulation, Trends in Pharmacol. Sciences 25: 280-289 (2004); Lewis & Garcia, Therapeutic Potential of Venom Peptides, Nat. Rev. Drug Discov. 2: 790-802 (2003)].

Small molecules inhibitors of Kv1.3 and IKCa1 potassium channels and the major calcium entry channel in T cells, CRAC, have also been developed to treat immune disorders [A. Schmitz et al. (2005) Molecul. Pharmacol. 68, 1254; K. G. Chandy et al. (2004) TIPS 25, 280; H. Wulff et al. (2001) J. Biol. Chem. 276, 32040; C. Zitt et al. (2004) J. Biol. Chem. 279, 12427], but obtaining small molecules with selectivity toward some of these targets has been difficult.

Calcium mobilization in lymphocytes is known to be a critical pathway in activation of inflammatory responses [M. W. Winslow et al. (2003) Current Opinion Immunol. 15, 299]. Compared to other cells, T cells show a unique sensitivity to increased levels of intracellular calcium and ion channels both directly and indirectly control this process. Inositol triphosphate (IP3) is the natural second messenger which activates the calcium signaling pathway. IP3 is produced following ligand-induced activation of the T cell receptor (TCR) and upon binding to its intracellular receptor (a channel) causes unloading of intracellular calcium stores. The endoplasmic reticulum provides one key calcium store. Thapsigargin, an inhibitor of the sarcoplasmic-endoplasmic reticulum calcium ATPase (SERCA), also causes unloading of intracellular stores and activation of the calcium signaling pathway in lymphocytes. Therefore, thapsigargin can be used as a specific stimulus of the calcium signaling pathway in T cells. The unloading of intracellular calcium stores in T cells is known to cause activation of a calcium channel on the cell surface which allows for influx of calcium from outside the cell. This store operated calcium channel (SOCC) on T cells is referred to as "CRAC" (calcium release activated channel) and sustained influx of calcium through this channel is known to be critical for full T cell activation [S. Feske et al. (2005) J. Exp. Med. 202, 651 and N. Venkatesh et al. (2004) PNAS 101, 8969]. For many years it has been appreciated that in order to maintain continued calcium influx into T cells, the cell membrane must remain in a hyperpolarized condition through efflux of potassium ions. In T cells, potassium efflux is accomplished by the voltage-gated potassium channel Kv1.3 and the calcium-activated potassium channel IKCa1 [K. G. Chandy et al. (2004) TIPS 25, 280]. These potassium channels therefore indirectly control the calcium signaling pathway, by allowing for the necessary potassium efflux that allows for a sustained influx of calcium through CRAC.

Sustained increases in intracellular calcium activate a variety of pathways in T cells, including those leading to activation of NFAT, NF-kB and AP-1 [Quintana-A (2005) Pflugers Arch. Eur. J. Physiol. 450, 1]. These events lead to various T cell responses including alteration of cell size and membrane organization, activation of cell surface effector molecules, cytokine production and proliferation. Several calcium sensing molecules transmit the calcium signal and orchestrate the cellular response. Calmodulin is one molecule that binds calcium, but many others have been identified (M. J. Berridge et al. (2003) Nat. Rev. Mol. Cell. Biol. 4,517). The calcium-calmodulin dependent phosphatase calcineurin is activated upon sustained increases in intracellular calcium and dephosphorylates cytosolic NFAT. Dephosphorylated NFAT quickly translocates to the nucleus and is widely accepted as a critical transcription factor for T cell activation (F. Macian (2005) Nat. Rev. Immunol. 5, 472 and N. Venkatesh et al. (2004) PNAS 101, 8969). Inhibitors of calcineurin, such as cyclosporin A (Neoral, SandImmune) and FK506 (Tacrolimus) are a main stay for treatment of severe immune disorders such as those resulting in rejection following solid organ transplant (I. M. Gonzalez-Pinto et al. (2005) Transplant. Proc. 37, 1713 and D. R. J. Kuypers (2005) Transplant International 18, 140). Neoral has been approved for the treatment of transplant rejection, severe rheumatoid arthritis (D. E. Yocum et al. (2000) Rheumatol. 39, 156) and severe psoriasis (J. Koo (1998) British J. Dermatol. 139, 88). Preclinical and clinical data has also been provided suggesting calcineurin inhibitors may have utility in treatment of inflammatory bowel disease (IBD; Baumgart D C (2006) Am. J. Gastroenterol. March 30; Epub ahead of print), multiple sclerosis (Ann. Neurol. (1990) 27, 591) and asthma (S. Rohatagi et al. (2000) J. Clin. Pharmacol. 40, 1211). Lupus represents another disorder that may benefit from agents blocking activation of helper T cells. Despite the importance of calcineurin in regulating NFAT in T cells, calcineurin is also expressed in other tissues (e.g. kidney) and cyclosporine A & FK506 have a narrow safety margin due to mechanism based toxicity. Renal toxicity and hypertension are common side effects that have limited the promise of cyclosporine & FK506. Due to concerns regarding toxicity, calcineurin inhibitors are used mostly to treat only severe immune disease (Bissonnette-R et al. (2006) J. Am. Acad. Dermatol. 54, 472). Kv1.3 inhibitors offer a safer alternative to calcineurin inhibitors for the treatment of immune disorders. This is because Kv1.3 also operates to control the calcium signaling pathway in T cells, but does so through a distinct mechanism to that of calcineurin inhibitors, and evidence on Kv1.3 expression and function show that Kv1.3 has a more restricted role in T cell biology relative to calcineurin, which functions also in a variety of non-lymphoid cells and tissues.

Calcium mobilization in immune cells also activates production of the cytokines interleukin 2 (IL-2) and interferon gamma (IFNg) which are critical mediators of inflammation. IL-2 induces a variety of biological responses ranging from expansion and differentiation of $CD4^+$ and $CD8^+$ T cells, to enhancement of proliferation and antibody secretion by B cells, to activation of NK cells [S. L. Gaffen & K. D. Liu (2004) Cytokine 28, 109]. Secretion of IL-2 occurs quickly following T cell activation and T cells represent the predominant source of this cytokine. Shortly following activation, the high affinity IL-2 receptor (IL2-R) is upregulated on T cells endowing them with an ability to proliferate in response to IL-2. T cells, NK cells, B cells and professional antigen presenting cells (APCs) can all secrete IFNg upon activation. T cells represent the principle source of IFNg production in mediating adaptive immune responses, whereas natural killer (NK) cells & APCs are likely an important source during host defense against infection [K. Schroder et al. (2004) J. Leukoc. Biol. 75, 163]. IFNg, originally called macrophage-activating factor, upregulates antigen processing and presentation by monocytes, macrophages and dendritic cells. IFNg mediates a diverse array of biological activities in many cell types [U. Boehm et al. (1997) Annu. Rev. Immunol. 15, 749] including growth & differentiation, enhancement of NK cell activity and regulation of B cell immunoglobulin production and class switching.

CD40L is another cytokine expressed on activated T cells following calcium mobilization and upon binding to its receptor on B cells provides critical help allowing for B cell germinal center formation, B cell differentiation and antibody isotype switching. CD40L-mediated activation of CD40 on B cells can induce profound differentiation and clonal expansion of immunoglobulin (Ig) producing B cells [S. Quezada et al. (2004) Annu. Rev. Immunol. 22, 307]. The CD40 receptor can also be found on dendritic cells and CD40L signaling can mediate dendritic cell activation and differentiation as well. The antigen presenting capacity of B cells and dendritic cells is promoted by CD40L binding, further illustrating the broad role of this cytokine in adaptive immunity. Given the essential role of CD40 signaling to B cell biology, neutralizing antibodies to CD40L have been examined in preclinical and clinical studies for utility in treatment of systemic lupus erythematosis (SLE),—a disorder characterized by deposition of antibody complexes in tissues, inflammation and organ damage [J. Yazdany and J Davis (2004) Lupus 13, 377].

Production of toxin peptides is a complex process in venomous organisms, and is an even more complex process synthetically. Due to their conserved disulfide structures and need for efficient oxidative refolding, toxin peptides present challenges to synthesis. Although toxin peptides have been used for years as highly selective pharmacological inhibitors of ion channels, the high cost of synthesis and refolding of the toxin peptides and their short half-life in vivo have impeded the pursuit of these peptides as a therapeutic modality. Far more effort has been expended to identify small molecule inhibitors as therapeutic antagonists of ion channels, than has been given the toxin peptides themselves. One exception is the recent approval of the small ω-conotoxin MVIIA peptide (Ziconotide™) for treatment of intractable pain. The synthetic and refolding production process for Ziconotide™, however, is costly and only results in a small peptide product with a very short half-life in vivo (about 4 hours).

A cost-effective process for producing therapeutics, such as but not limited to, inhibitors of ion channels, is a desideratum provided by the present invention, which involves toxin peptides fused, or otherwise covalently conjugated to a vehicle.

SUMMARY OF THE INVENTION

The present invention relates to a composition of matter of the formula:

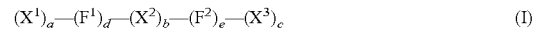

and multimers thereof, wherein:

$F^1$ and $F^2$ are half-life extending moieties, and d and e are each independently 0 or 1, provided that at least one of d and e is 1;

$X^1$, $X^2$, and $X^3$ are each independently $-(L)_f-P-(L)_g-$, and f and g are each independently 0 or 1;

P is a toxin peptide of no more than about 80 amino acid residues in length, comprising at least two intrapeptide disulfide bonds;

L is an optional linker (present when f=1 and/or g=1); and a, b, and c are each independently 0 or 1, provided that at least one of a, b and c is 1.

The present invention thus concerns molecules having variations on Formula 1, such as the formulae:

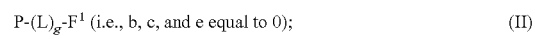

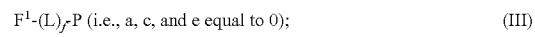

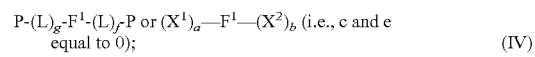

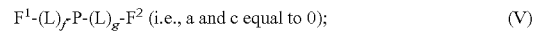

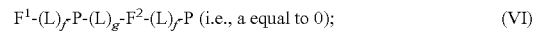

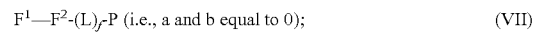

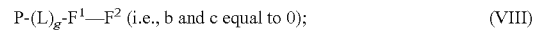

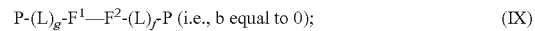

and any multimers of any of these, when stated conventionally with the N-terminus of the peptide(s) on the left. All of such molecules of Formulae II-IX are within the meaning of Structural Formula I. Within the meaning of Formula I, the toxin peptide (P), if more than one is present, can be independently the same or different from any other toxin peptide(s) also present in the inventive composition, and the linker moiety ($(L)_f$ and/or $(L)_g$), if present, can be independently the same or different from any other linker, or linkers, that may be present in the inventive composition. Conjugation of the toxin peptide(s) to the half-life extending moiety, or moieties, can be via the N-terminal and/or C-terminal of the toxin peptide, or can be intercalary as to its primary amino acid sequence, $F^1$ being linked closer to the toxin peptide's N-terminus than is linked $F^2$. Examples of useful half-life extending moieties ($F^1$ or $F^2$) include immunoglobulin Fc domain, human serum albumin (HSA), or poly(ethylene glycol) (PEG). These and other half-life extending moieties described herein are useful, either individually or in combination.

The present invention also relates to a composition of matter, which includes, conjugated or unconjugated, a toxin peptide analog of ShK, OSK1, ChTx, or Maurotoxin modified from the native sequences at one or more amino acid residues, having greater Kv1.3 or IKCa1 antagonist activity, and/or target selectivity, compared to a ShK, OSK1, or Maurotoxin (MTX) peptides having a native sequence. The toxin peptide analogs comprise an amino acid sequence selected from any of the following:

SEQ ID NOS: 88, 89, 92, 148 through 200, 548 through 561, 884 through 949, or 1295 through 1300 as set forth in Table 2; or SEQ ID NOS: 980 through 1274, 1303, or 1308 as set forth in Table 7; or
SEQ ID NOS: 330 through 337, 341, 1301, 1302, 1304 through 1307, 1309, 1311, 1312, and 1315 through 1336 as set forth in Table 13; or
SEQ ID NOS: 36, 59, 344-346, or 1369 through 1390 as set forth in Table 14.

The present invention also relates to other toxin peptide analogs that comprise an amino acid sequence selected from any of the following:
SEQ ID NOS: 201 through 225 as set forth in Table 3; or
SEQ ID NOS: 242 through 248 or 250 through 260 as set forth in Table 4; or
SEQ ID NOS: 261 through 275 as set forth in Table 5; or
SEQ ID NOS: 276 through 293 as set forth in Table 6; or
SEQ ID NOS: 299 through 315 as set forth in Table 8; or
SEQ ID NOS: 316 through 318 as set forth in Table 9; or
SEQ ID NO: 319 as set forth in Table 10; or
SEQ ID NO: 327 or 328 as set forth in Table 11; or
SEQ ID NOS: 330 through 337, 341, 1301, 1302, 1304 through 1307, 1309, 1311, 1312, or 1315 through 1336 as set forth in Table 13;
SEQ ID NOS: 1369 through 1390 as set forth in Table 14; or
SEQ ID NOS: 348 through 353 as set forth in Table 16; or
SEQ ID NOS: 357 through 362, 364 through 368, 370, 372 through 385, or 387 through 398 as set forth in Table 19; or
SEQ ID NOS: 399 through 408 as set forth in Table 20; or
SEQ ID NOS: 410 through 421 as set forth in Table 22; or
SEQ ID NOS: 422, 424, 426, or 428 as set forth in Table 23; or
SEQ ID NOS: 430 through 437 as set forth in Table 24; or
SEQ ID NOS: 438 through 445 as set forth in Table 25; or
SEQ ID NOS: 447, 449, 451, 453, 455, or 457 as set forth in Table 26; or
SEQ ID NOS: 470 through 482 or 484 through 493 as set forth in Table 28; or
SEQ ID NOS: 495 through 506 as set forth in Table 29; or
SEQ ID NOS: 507 through 518 as set forth in Table 30.

The present invention is also directed to a pharmaceutical composition that includes the inventive composition of matter and a pharmaceutically acceptable carrier.

The compositions of this invention can be prepared by conventional synthetic methods, recombinant DNA techniques, or any other methods of preparing peptides and fusion proteins well known in the art. Compositions of this invention that have non-peptide portions can be synthesized by conventional organic chemistry reactions, in addition to conventional peptide chemistry reactions when applicable.

The primary use contemplated is as therapeutic and/or prophylactic agents. The inventive compositions incorporating the toxin peptide can have activity and/or ion channel target selectivity comparable to—or even greater than—the unconjugated peptide.

Accordingly, the present invention includes a method of treating an autoimmune disorder, which involves administering to a patient who has been diagnosed with an autoimmune disorder, such as multiple sclerosis, type 1 diabetes, psoriasis, inflammatory bowel disease, contact-mediated dermatitis, rheumatoid arthritis, psoriatic arthritis, asthma, allergy, restinosis, systemic sclerosis, fibrosis, scleroderma, glomerulonephritis, Sjogren syndrome, inflammatory bone resorption, transplant rejection, graft-versus-host disease, or lupus, a therapeutically effective amount of the inventive composition of matter (preferably comprising a Kv1.3 antagonist peptide or IKCa1 antagonist peptide), whereby at least one symptom of the disorder is alleviated in the patient.

The present invention is further directed to a method of preventing or mitigating a relapse of a symptom of multiple sclerosis, which method involves administering to a patient, who has previously experienced at least one symptom of multiple sclerosis, a prophylactically effective amount of the inventive composition of matter (preferably comprising a Kv1.3 antagonist peptide or IKCa1 antagonist peptide), such that the at least one symptom of multiple sclerosis is prevented from recurring or is mitigated.

Although mostly contemplated as therapeutic agents, compositions of this invention can also be useful in screening for therapeutic or diagnostic agents. For example, one can use an Fc-peptide in an assay employing anti-Fc coated plates. The half-life extending moiety, such as Fc, can make insoluble peptides soluble and thus useful in a number of assays.

Numerous additional aspects and advantages of the present invention will become apparent upon consideration of the figures and detailed description of the invention.

BRIEF DESCRIPTION OF THE FIGURES

FIG. 1 shows schematic structures of some exemplary Fc dimers that can be derived from an IgG1 antibody. "Fc" in the figure represents any of the Fc variants within the meaning of "Fc domain" herein. "X1" and "X2" represent peptides or linker-peptide combinations as defined hereinafter. The specific dimers are as follows.

FIG. 2 shows schematic structures of some embodiments of the composition of the invention that shows a single unit of the pharmacologically active toxin peptide.

FIG. 3 shows exemplary nucleic acid and amino acid sequences (SEQ ID NOS: 1 and 2, respectively) of human IgG1 Fc that is optimized for mammalian expression and can be used in this invention.

FIG. 4 shows exemplary nucleic acid and amino acid sequences (SEQ ID NOS: 3 and 4, respectively) of human IgG1 Fc that is optimized for bacterial expression and can be used in this invention.

FIG. 6 shows an alignment of the voltage-gated potassium channel inhibitor *Stichodactyla helianthus* (ShK) with other closely related members of the sea anemone toxin family. The sequence of the 35 amino acid mature ShK toxin (Accession #P29187) isolated from the venom of *Stichodactyla helianthus* is shown aligned to other closely related members of the sea anemone family. The consensus sequence and predicted disulfide linkages are shown, with highly conserved residues being shaded. The HmK peptide toxin sequence shown (Swiss-Protein Accession #O97436) is of the immature precursor from the Magnificent sea anemone (*Radianthus magnifica; Heteractis magnifica*) and the putative signal peptide is underlined. The mature HmK peptide toxin would be predicted to be 35 amino acids in length and span residues 40 through 74. AeK is the mature peptide toxin, isolated from the venom of the sea anemone *Actinia equine* (Accession #P81897). The sequence of the mature peptide toxin AsKS (Accession #Q9TWG1) and BgK (Accession #P29186) isolated from the venom of the sea anemone *Anemonia sulcata* and *Bunodosoma granulifera*, respectively, are also shown. FIG. 6A shows the amino acid alignment (SEQ ID NO: 10) of ShK to other members of the sea anemone family of toxins, HmK (SEQ ID NO: 6 (Mature Peptide), (SEQ ID NO: 542, Signal and Mature Peptide portions)), AeK (SEQ ID NO: 7), AsKs (SEQ ID NO: 8), and BgK (SEQ ID NO: 9). The predicted disulfide linkages are shown and conserved residues are highlighted. (HmK, SEQ ID NO: 543; ShK, SEQ ID NO: 10; AeK, SEQ ID NO: 544; AsKS, SEQ ID NO: 545). FIG. 6B shows a disulfide linkage map for this family having 3 disulfide linkages (C1-C6, C2-C4, C3-C5).

FIG. 7 shows an amino acid alignment of the alpha-scorpion toxin family of potassium channel inhibitors. (BmKK1, SEQ ID NO: 11; BmKK4, SEQ ID NO: 12; PBTx1, SEQ ID NO: 14; Tc32, SEQ ID NO: 13; BmKK6, SEQ ID NO: 15; P01, SEQ ID NO: 16; Pi2, SEQ ID NO: 17; Pi3, SEQ ID NO: 18; Pi4, SEQ ID NO: 19; MTX, SEQ ID NO: 20; Pi1, SEQ ID NO: 21; HsTx1, SEQ ID NO: 61; AgTx2, SEQ ID NO: 23; KTX1, SEQ ID NO: 24; OSK1, SEQ ID NO: 25; BmKTX, SEQ ID NO: 22; HgTX1, SEQ ID NO: 27; MgTx, SEQ ID NO: 28; C11Tx1, SEQ ID NO: 29; NTX, SEQ ID NO: 30; Tc30, SEQ ID NO: 31; TsTX-Ka, SEQ ID NO: 32; PBTx3, SEQ ID NO: 33; Lqh 15-1, SEQ ID NO: 34; MartenTx, SEQ ID NO: 37; ChTx, SEQ ID NO:36; ChTx-Lq2, SEQ ID NO: 42; IbTx, SEQ ID NO: 38; SloTx, SEQ ID NO: 39; BmTx1; SEQ ID NO: 43; BuTx, SEQ ID NO: 41; AmmTx3, SEQ ID NO: 44; AaTX1, SEQ ID NO: 45; BmTX3, SEQ ID NO: 46; Tc1, SEQ ID NO: 48; OSK2, SEQ ID NO: 49; TsK, SEQ ID NO: 54; CoTx1, SEQ ID NO:55; CoTx2, SEQ ID NO: 871; BmPo5, SEQ ID NO: 60; ScyTx, SEQ ID NO: 51; P05, SEQ ID NO: 52; Tamapin, SEQ ID NO: 53; and TmTx, SEQ ID NO: 691. Highly conserved residues are shaded and a consensus sequence is listed. Subfamilies of the α-KTx are listed and are from Rodriguez de la Vega, R. C. et al. (2003) *TIPS* 24: 222-227. A list of some ion channels reported to antagonized is listed (IK=IKCa, BK=BKCa, SK=SKCa, Kv=voltage-gated K+ channels). Although most family members in this alignment represent the mature peptide product, several represent immature or modified forms of the peptide and these include: BmKK1, BmKK4, BmKK6, BmKTX, MartenTx, ChTx, ChTx-Lq2, BmTx1, AaTx1, BmTX3, TsK, CoTx1, BmP05.

FIG. 8 shows an alignment of toxin peptides converted to peptibodies in this invention (Apamin, SEQ ID NO: 68; HaTx1, SEQ ID NO: 494; ProTx1, SEQ ID NO: 56; PaTx2, SEQ ID NO: 57; ShK[2-35], SEQ ID NO: 92; ShK[1-35], SEQ ID NO: 5; HmK, SEQ ID NO: 6; ChTx (K32E), SEQ ID NO: 59; ChTx, SEQ ID NO: 36; IbTx, SEQ ID NO: 38; OSK1 (E16K, K20D), SEQ ID NO: 296; OSK1, SEQ ID NO: 25; AgTx2, SEQ ID NO: 23; KTX1, SEQ ID NO: 24; MgTx, SEQ ID NO: 28; NTX, SEQ ID NO: 30; MTX, SEQ ID NO: 20; Pi2, SEQ ID NO: 17; HsTx1, SEQ ID NO: 61; Anuroctoxin [AnTx], SEQ ID NO: 62; BeKm1, SEQ ID NO: 63; ScyTx, SEQ ID NO: 51; ωGVIA, SEQ ID NO: 64; ωMVIIa, SEQ ID NO: 65; Ptu1, SEQ ID NO: 66; and CTX, SEQ ID NO: 67). The original sources of the toxins is indicated, as well as, the number of cysteines in each. Key ion channels targeted are listed. The alignment shows clustering of toxin peptides based on their source and ion channel target impact.

FIG. 9 shows disulfide arrangements within the toxin family. The number of disulfides and the disulfide bonding order for each subfamily is indicated. A partial list of toxins that fall within each disulfide linkage category is presented.

FIG. 11A-C shows the nucleic acid (SEQ ID NO: 69 and SEQ ID NO: 1358) and encoded amino acid (SEQ ID NO:70, SEQ ID NO:1359 and SEQ ID NO: 1360) sequences of residues 5131-6660 of pAMG21ampR-Fc-pep. The sequences of the Fc domain (SEQ ID NOS: 71 and 72) exclude the five C-terminal glycine residues. This vector enables production of peptibodies in which the peptide-linker portion is at the C-terminus of the Fc domain.

FIG. 12A-C shows the nucleic acid (SEQ ID NO: 73 and SEQ ID NO: 1361) and encoded amino acid (SEQ ID NO:74, SEQ ID NO: 1362 and SEQ ID NO: 1363) sequences of residues 5131-6319 of pAMG21ampR-Pep-Fc. The sequences of the Fc domain (SEQ ID NOS: 75 and 76) exclude the five N-terminal glycine residues. This vector enables production of peptibodies in which the peptide-linker portion is at the N-terminus of the Fc domain.

FIG. 12E-G shows the nucleic acid (SEQ ID NO:1339) and encoded amino acid sequences of pAMG21ampR-Pep-Fc (SEQ ID NO:1340, SEQ ID NO:1341, and SEQ ID NO:1342). The sequences of the Fc domain (SEQ ID NOS: 75 and 76) exclude the five N-terminal glycine residues. This vector enables production of peptibodies in which the peptide-linker portion is at the N-terminus of the Fc domain.

FIG. 14 shows the nucleotide and encoded amino acid sequences (SEQ. ID. NOS: 77 and 78, respectively) of the molecule identified as "Fc-L10-ShK[1-35]" in Example 1 hereinafter. The L10 linker amino acid sequence (SEQ ID NO: 79) is underlined.

FIG. 15 shows the nucleotide and encoded amino acid sequences (SEQ. ID. NOS: 80 and 81, respectively) of the molecule identified as "Fc-L10-ShK[2-35]" in Example 2 hereinafter. The same L10 linker amino acid sequence (SEQ ID NO: 79) as used in Fc-L10-ShK[1-35] (FIG. 14) is underlined.

FIG. 16 shows the nucleotide and encoded amino acid sequences (SEQ. ID. NOS: 82 and 83, respectively) of the molecule identified as "Fc-L25-ShK[2-35]" in Example 2 hereinafter. The L25 linker amino acid sequence (SEQ ID NO: 84) is underlined.

Lane 3: 10 µl Fc-L10-ShK; Lane 4: 5 µl Fc-L10-ShK; Lane 5; molecular weight markers; Lane 6: blank; Lane 7: 15 µl No DNA control; Lane 8: 10 µl No DNA control; Lane 9: 5 µl No DNA control; Lane 10; molecular weight markers.

Figure 24A:
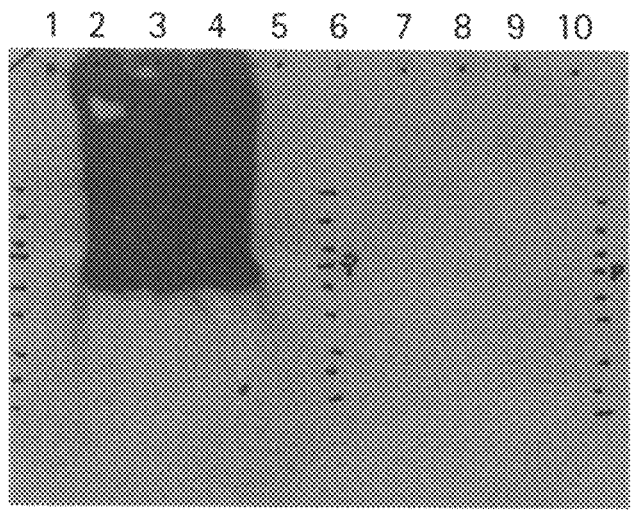
FIG. 24A shows a western blot of conditioned medium from HEK 293 cells transiently transfected with Fc-L10-ShK [1-35]. Lane 1: molecular weight markers; Lane 2: 15 µl Fc-L10-ShK.
Figure 24B:
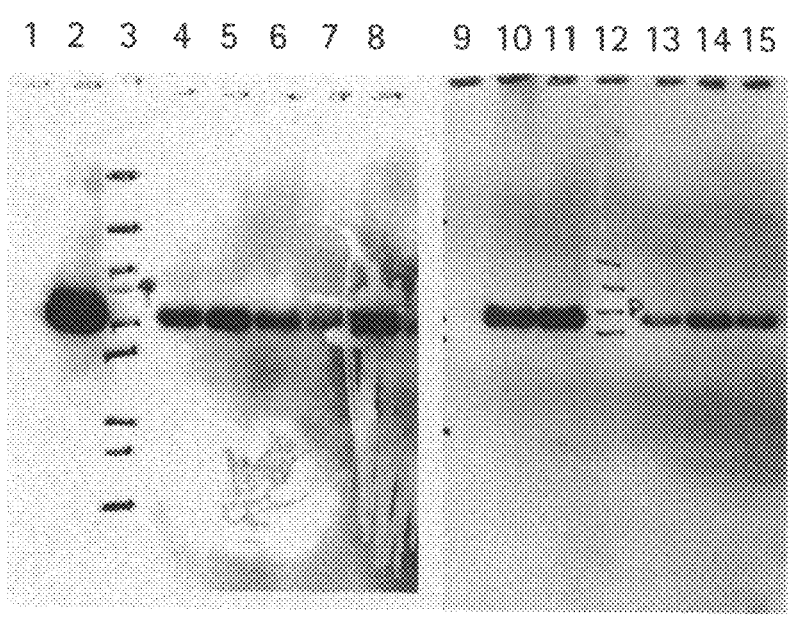

FIG. 24B shows a western blot of with 15 µl of conditioned medium from clones of Chinese Hamster Ovary (CHO) cells stably transfected with Fc-L-ShK[1-35]. Lanes 1-15 were loaded as follows: blank, BB6, molecular weight markers, BB5, BB4, BB3, BB2, BB1, blank, BD6, BD5, molecular weight markers, BD4, BD3, BD2.

Figure 25A:
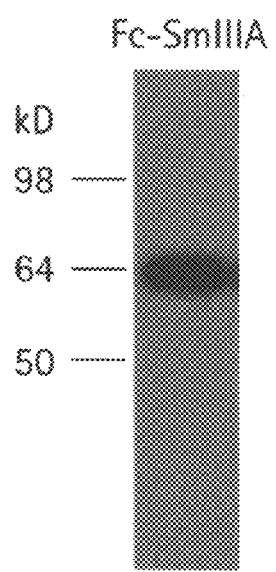

FIG. 25A shows a western blot of a non-reducing SDS-PAGE gel containing conditioned medium from 293T cells transiently transfected with Fc-L-SmIIIA.

Figure 25B:
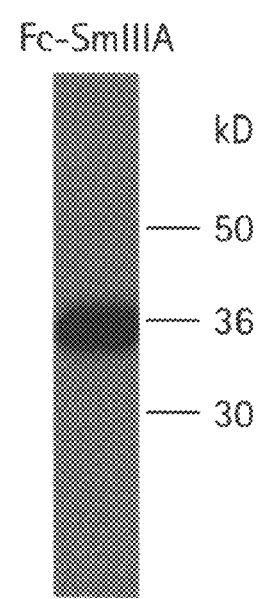

FIG. 25B shows a western blot of a reducing SDS-PAGE gel containing conditioned medium from 293T cells transiently transfected with Fc-L-SmIIIA.

Figure 26A:
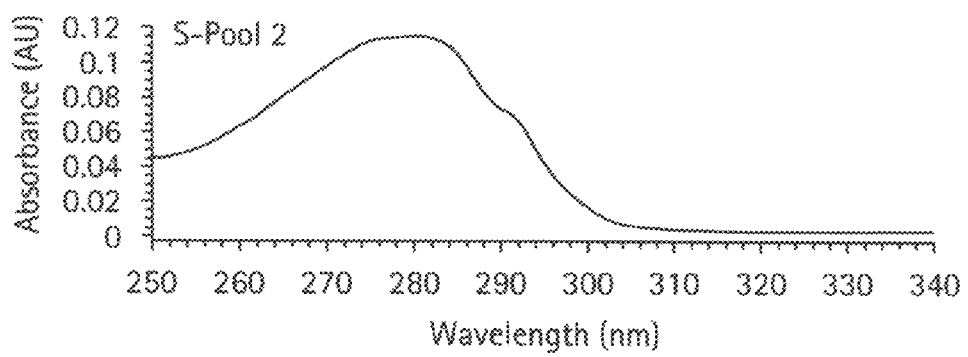

FIG. 26A shows a Spectral scan of 10 µl purified Fc-L10-ShK[1-35] product from stably transfected CHO cells diluted in 700 µl PBS (blanking buffer) using a Hewlett Packard 8453 spectrophotometer and a 1-cm path length quartz cuvette.

Figure 26B:
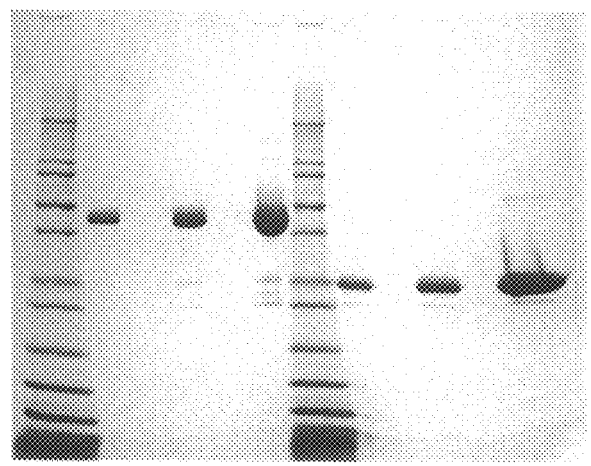

FIG. 26B shows Coomassie brilliant blue stained tris-glycine 4-20% SDS-PAGE of the final Fc-L10-ShK[1-35] product. Lanes 1-12 were loaded as follows: Novex Mark 12 wide range protein standards, 0.5 µg product non-reduced, blank, 2.0 µg product non-reduced, blank, 10 µg product non-reduced, Novex Mark 12 wide range protein standards, 0.5 µg product reduced, blank, 2.0 µg product reduced, blank, and 10 µg product reduced.

Figure 26C:
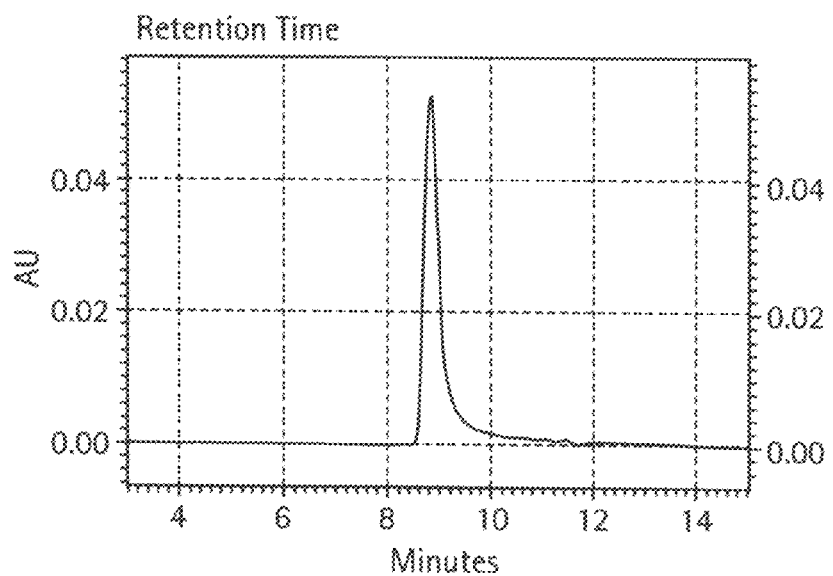

FIG. 26C shows size exclusion chromatography on 20 µg of the final Fc-L10-ShK[1-35] product injected on to a Phenomenex BioSep SEC 3000 column (7.8×300 mm) in 50 mM NaH$_2$PO$_4$, 250 mM NaCl, and pH 6.9 at 1 ml/min observing the absorbance at 280 nm.

Figure 26D:
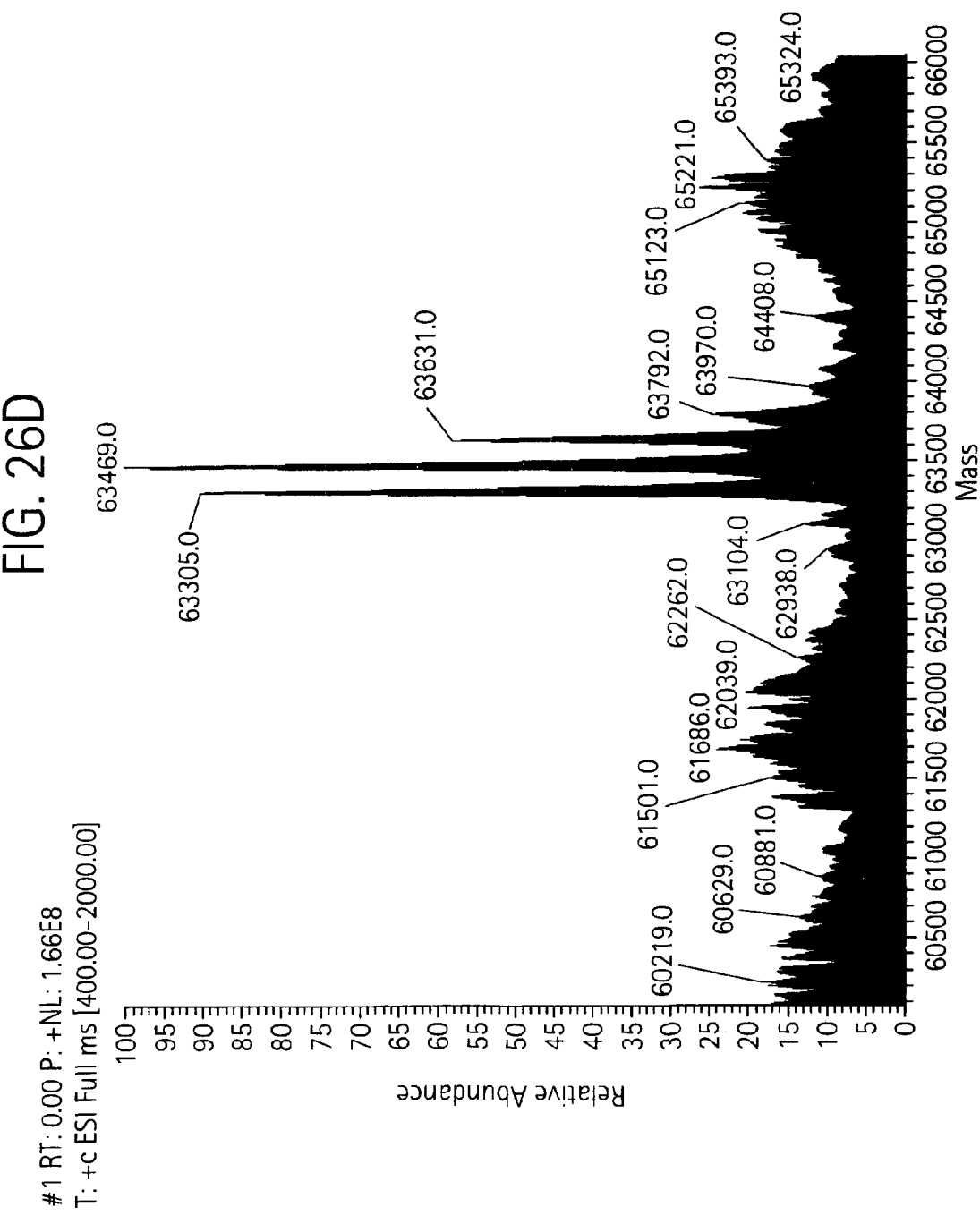

FIG. 26D shows a MALDI mass spectral analysis of the final sample of Fc-L10-ShK[1-35] analyzed using a Voyager DE-RP time-of-flight mass spectrometer equipped with a nitrogen laser (337 nm, 3 ns pulse). The positive ion/linear mode was used, with an accelerating voltage of 25 kV. Each spectrum was produced by accumulating data from ~200 laser shots. External mass calibration was accomplished using purified proteins of known molecular masses.

Figure 27A:
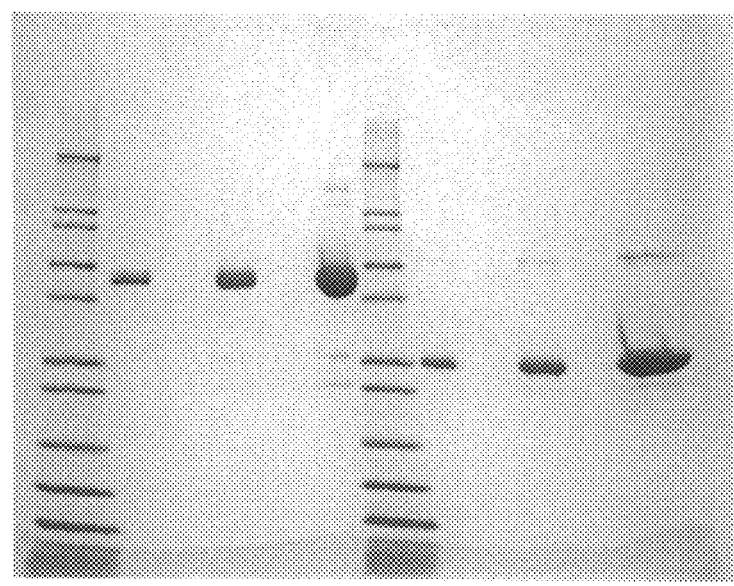

FIG. 27A shows a Coomassie brilliant blue stained tris-glycine 4-20% SDS-PAGE of the final purified Fc-L10-ShK [2-35] product from stably transfected CHO cells. Lane 1-12 were loaded as follows: Novex Mark 12 wide range protein standards, 0.5 µg product non-reduced, blank, 2.0 µg product non-reduced, blank, 10 µg product non-reduced, Novex Mark 12 wide range protein standards, 0.5 µg product reduced, blank, 2.0 µg product reduced, blank, and 10 µg product reduced.

Figure 27B:
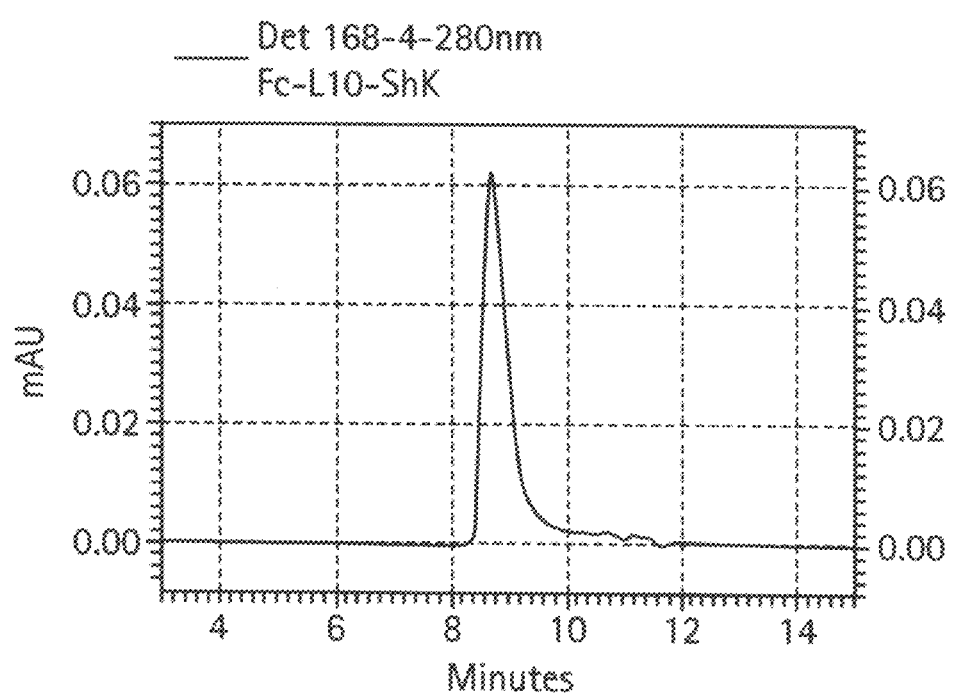

FIG. 27B shows size exclusion chromatography on 50 µg of the purified Fc-L10-ShK[2-35] injected on to a Phenomenex BioSep SEC 3000 column (7.8×300 mm) in 50 mM NaH$_2$PO$_4$, 250 mM NaCl, and pH 6.9 at 1 ml/min observing the absorbance at 280 nm.

Figure 27C:
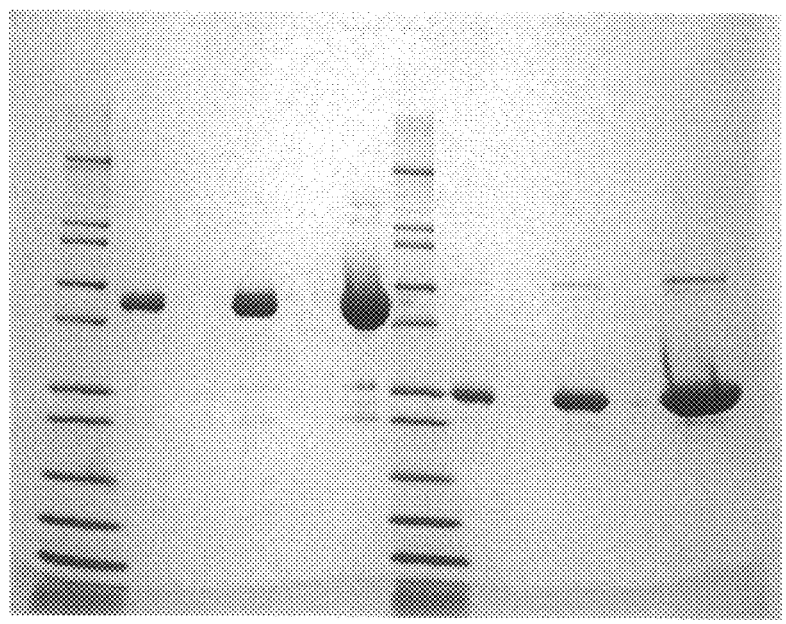

FIG. 27C shows a Coomassie brilliant blue stained tris-glycine 4-20% SDS-PAGE of Fc-L5-ShK[2-35] purified from stably transfected CHO cells. Lane 1-12 are loaded as follows: Novex Mark 12 wide range protein standards, 0.5 µg product non-reduced, blank, 2.0 µg product non-reduced, blank, 10 µg product non-reduced, Novex Mark 12 wide range protein standards, 0.5 µg product reduced, blank, 2.0 µg product reduced, blank, and 10 µg product reduced.

Figure 27D:
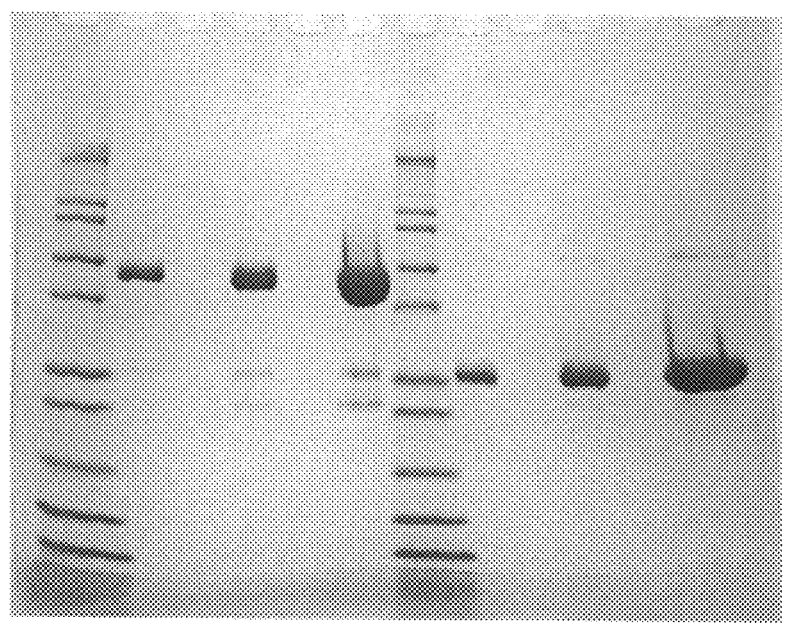

FIG. 27D shows a Coomassie brilliant blue stained tris-glycine 4-20% SDS-PAGE of Fc-L25-ShK[2-35] purified from stably transfected CHO cells. Lane 1-12 are loaded as follows: Novex Mark 12 wide range protein standards, 0.5 µg product non-reduced, blank, 2.0 µg product non-reduced, blank, 10 µg product non-reduced, Novex Mark 12 wide range protein standards, 0.5 µg product reduced, blank, 2.0 µg product reduced, blank, and 10 µg product reduced.

Figure 27E:
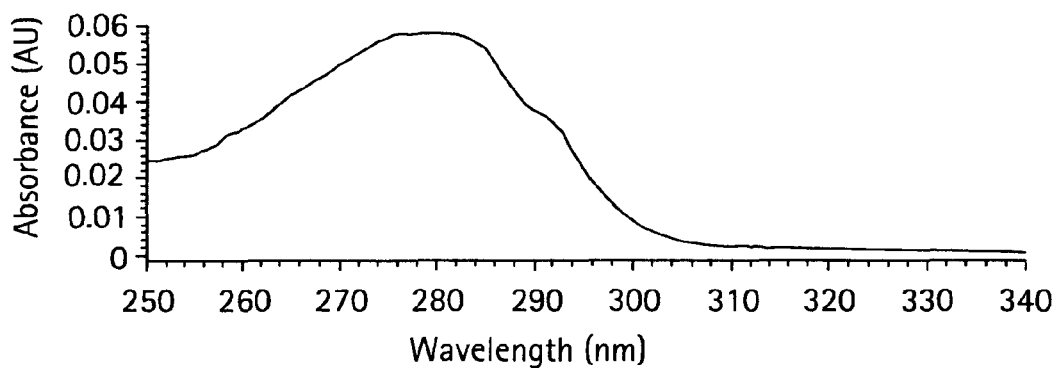

FIG. 27E shows a spectral scan of 10 µl of the Fc-L10-ShK [2-35] product diluted in 700 µl PBS (blanking buffer) using a Hewlett Packard 8453 spectrophotometer and a 1 cm path length quartz cuvette.

Figure 27F:
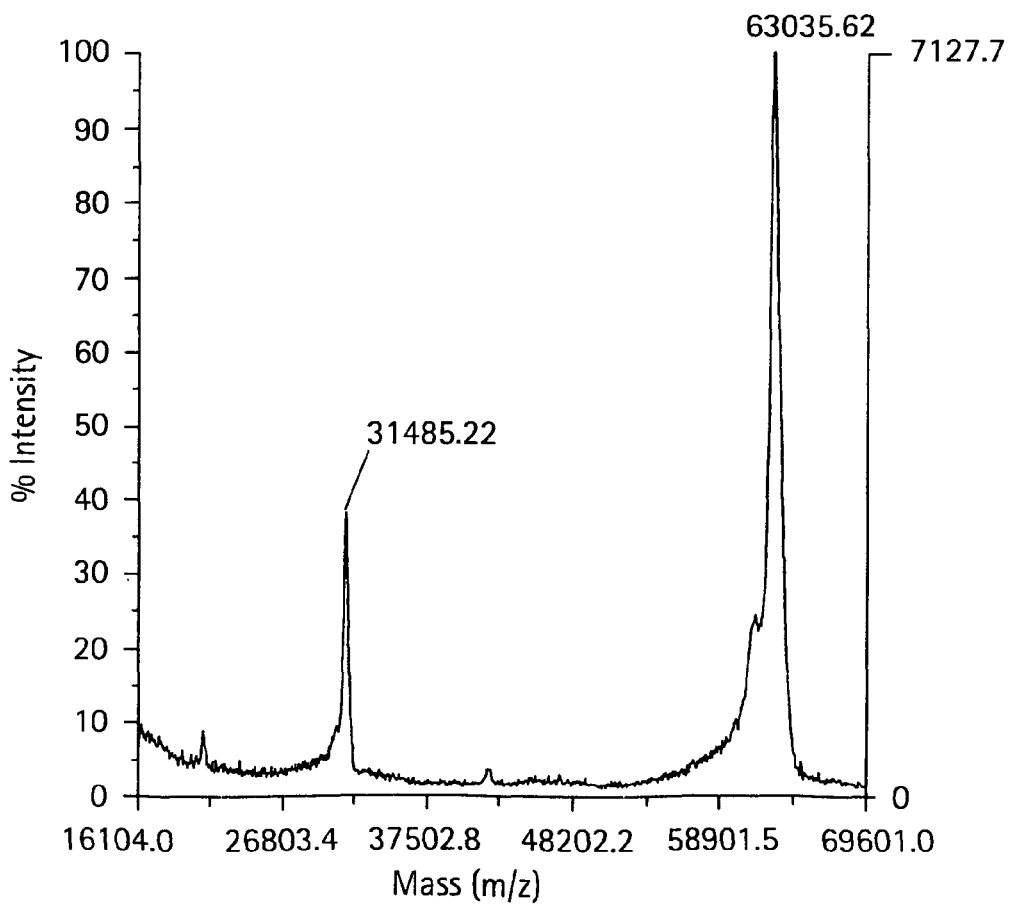

FIG. 27F shows a MALDI mass spectral analysis of the final sample of Fc-L10-ShK[2-35] analyzed using a Voyager DE-RP time-of-flight mass spectrometer equipped with a nitrogen laser (337 nm, 3 ns pulse). The positive ion/linear mode was used, with an accelerating voltage of 25 kV. Each spectrum was produced by accumulating data from about 200 laser shots. External mass calibration was accomplished using purified proteins of known molecular masses.

Figure 27G:
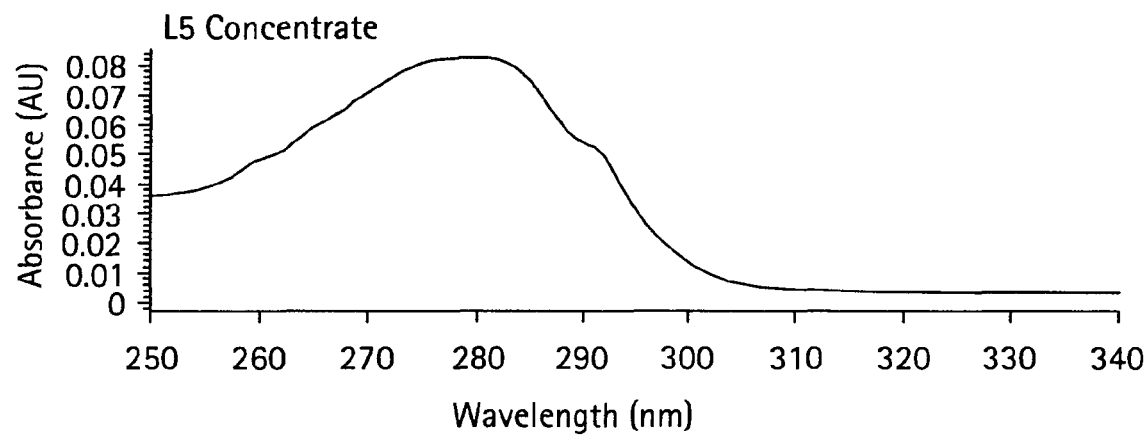

FIG. 27G shows a spectral scan of 10 µl of the Fc-L5-ShK [2-35] product diluted in 700 µl PBS (blanking buffer) using a Hewlett Packard 8453 spectrophotometer and a 1 cm path length quartz cuvette.

Figure 27H:
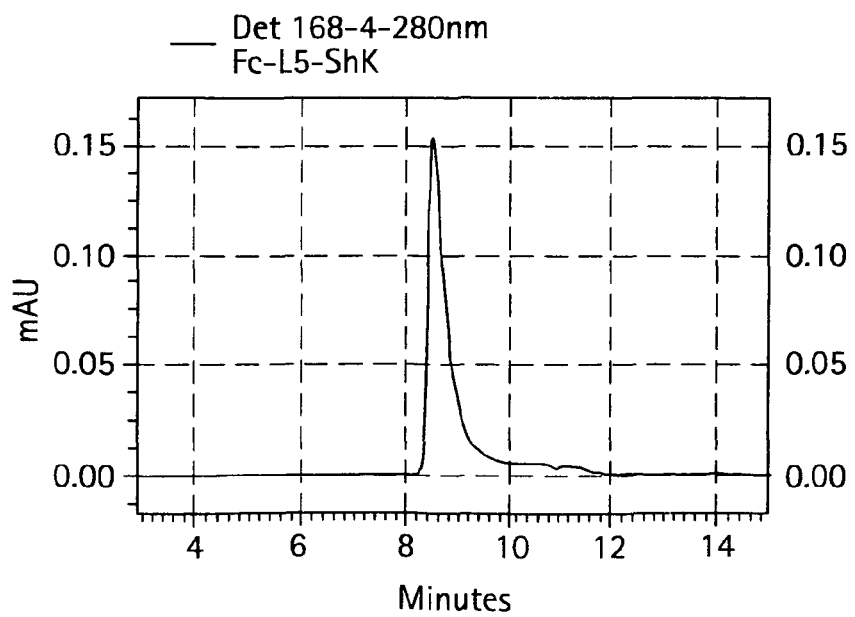

FIG. 27H shows the size exclusion chromatography on 50 mg of the final Fc-L5-ShK[2-35] product injected on to a Phenomenex BioSep SEC 3000 column (7.8×300 mm) in 50 mM NaH2PO4, 250 mM NaCl, pH 6.9 at 1 ml/min observing the absorbance at 280 nm.

Figure 27I:
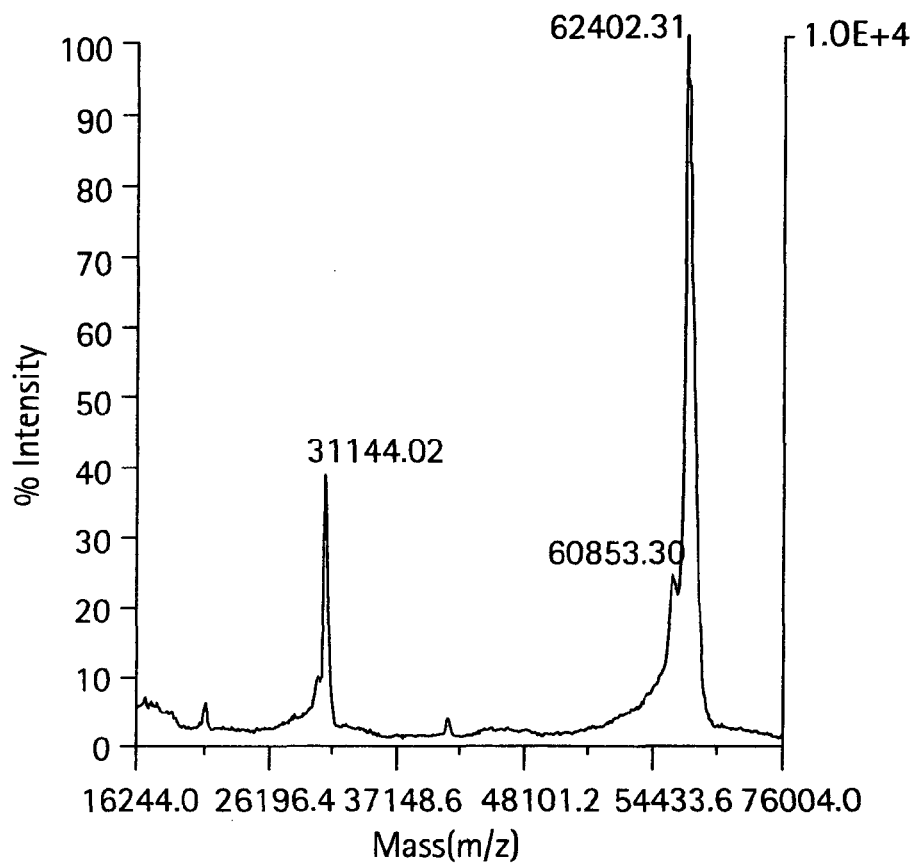

FIG. 27I shows a MALDI mass spectral analysis of the final sample of Fc-L5-ShK[2-35] analyzed using a Voyager DE-RP time-of-flight mass spectrometer equipped with a nitrogen laser (337 nm, 3 ns pulse). The positive ion/linear mode was used, with an accelerating voltage of 25 kV. Each spectrum was produced by accumulating data from ~200 laser shots. External mass calibration was accomplished using purified proteins of known molecular masses.

Figure 27J:
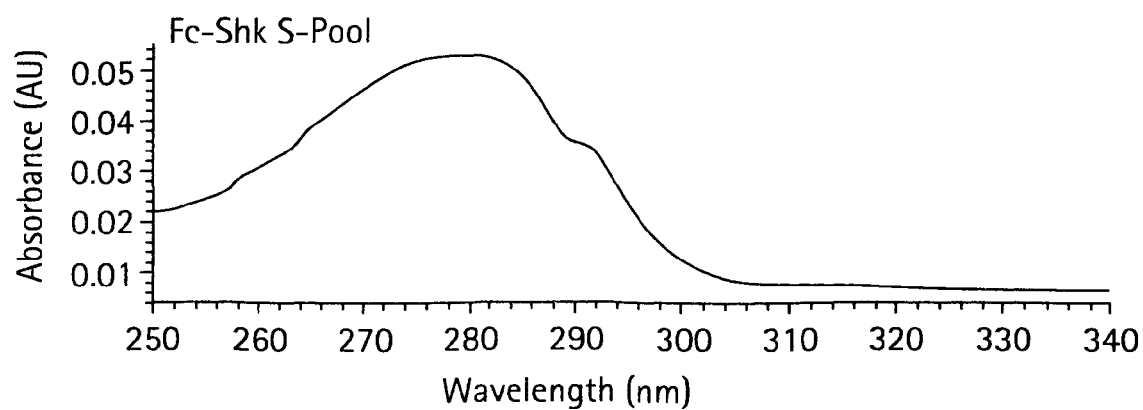

FIG. 27J shows a Spectral scan of 20 μl of the product diluted in 700 μl PBS (blanking buffer) using a Hewlett Packard 8453 spectrophotometer and a 1 cm path length quartz cuvette.

Figure 27K:
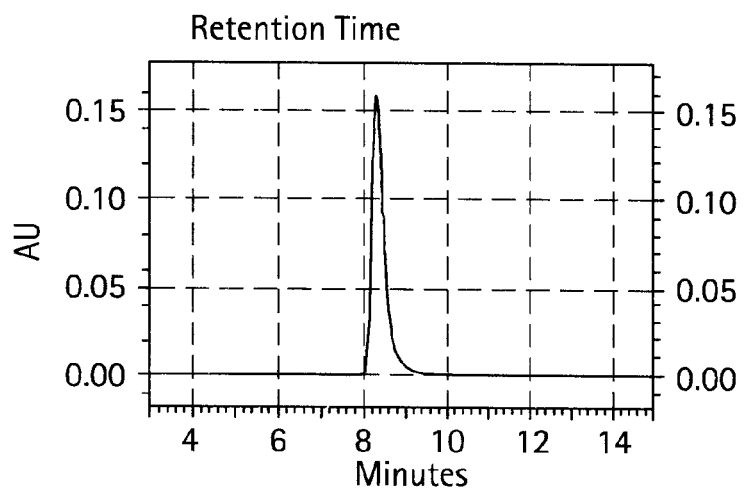

FIG. 27K shows the size exclusion chromatography on 50 μg of the final Fc-L25-ShK[2-35] product injected on to a Phenomenex BioSep SEC 3000 column (7.8×300 mm) in 50 mM $NaH_2PO_4$, 250 mM NaCl, pH 6.9 at 1 ml/min observing the absorbance at 280 nm.

Figure 27L:
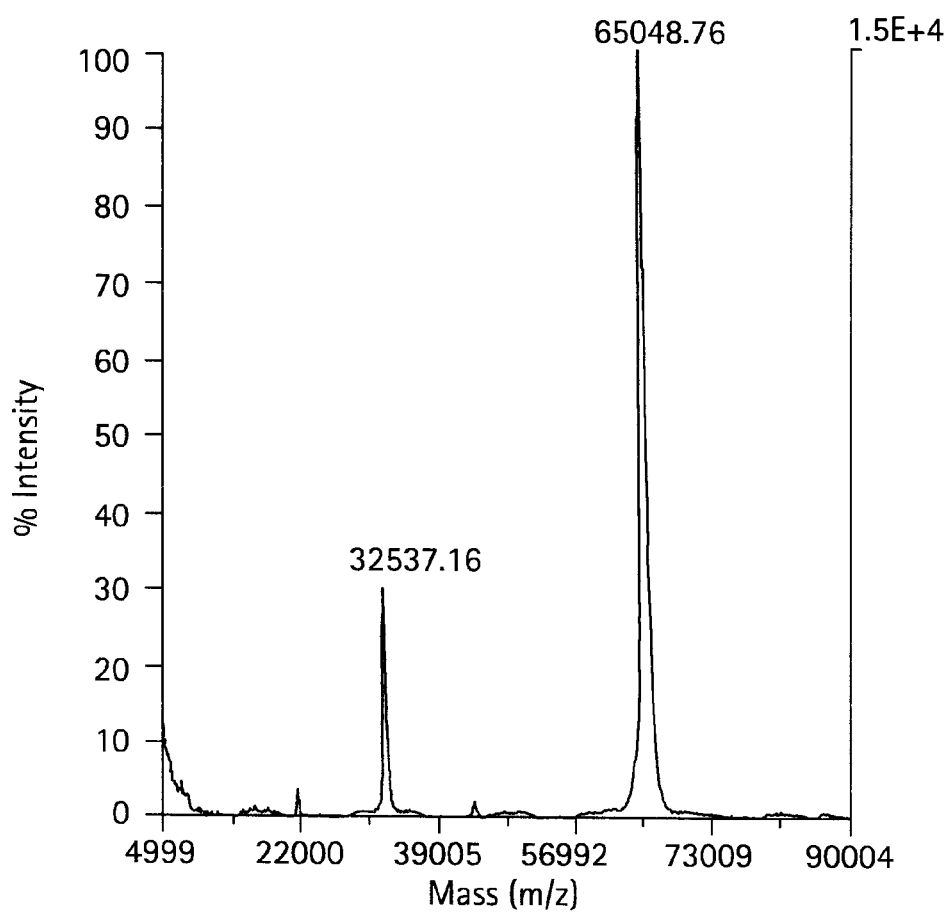

FIG. 27L shows a MALDI mass spectral analysis of the final sample of Fc-L25-ShK[2-35] analyzed using a Voyager DE-RP time-of-flight mass spectrometer equipped with a nitrogen laser (337 nm, 3 ns pulse). The positive ion/linear mode was used, with an accelerating voltage of 25 kV. Each spectrum was produced by accumulating data from about 200 laser shots. External mass calibration was accomplished using purified proteins of known molecular masses.

Figure 28A:
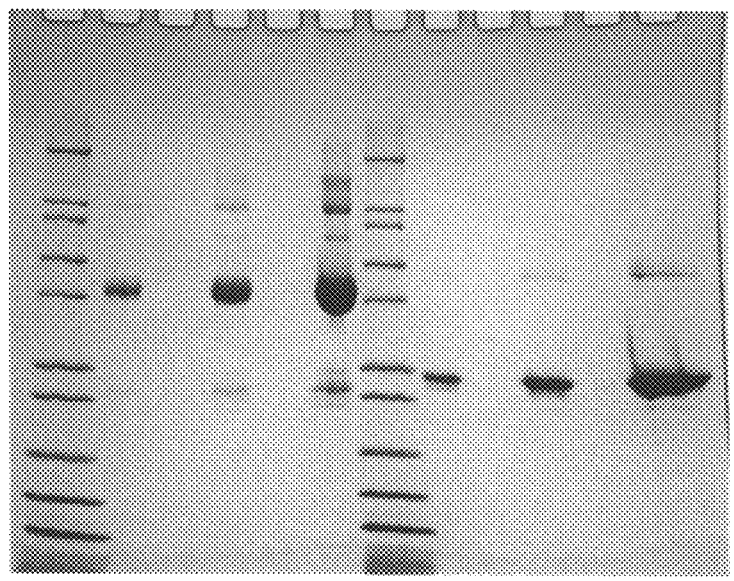

FIG. 28A shows a Coomassie brilliant blue stained tris-glycine 4-20% SDS-PAGE of Fc-L10-KTX1 purified and refolded from bacterial cells. Lane 1-12 are loaded as follows: Novex Mark 12 wide range protein standards, 0.5 μg product non-reduced, blank, 2.0 μg product non-reduced, blank, 10 μg product non-reduced, Novex Mark 12 wide range protein standards, 0.5 μg product reduced, blank, 2.0 μg product reduced, blank, and 10 μg product reduced.

Figure 28B:
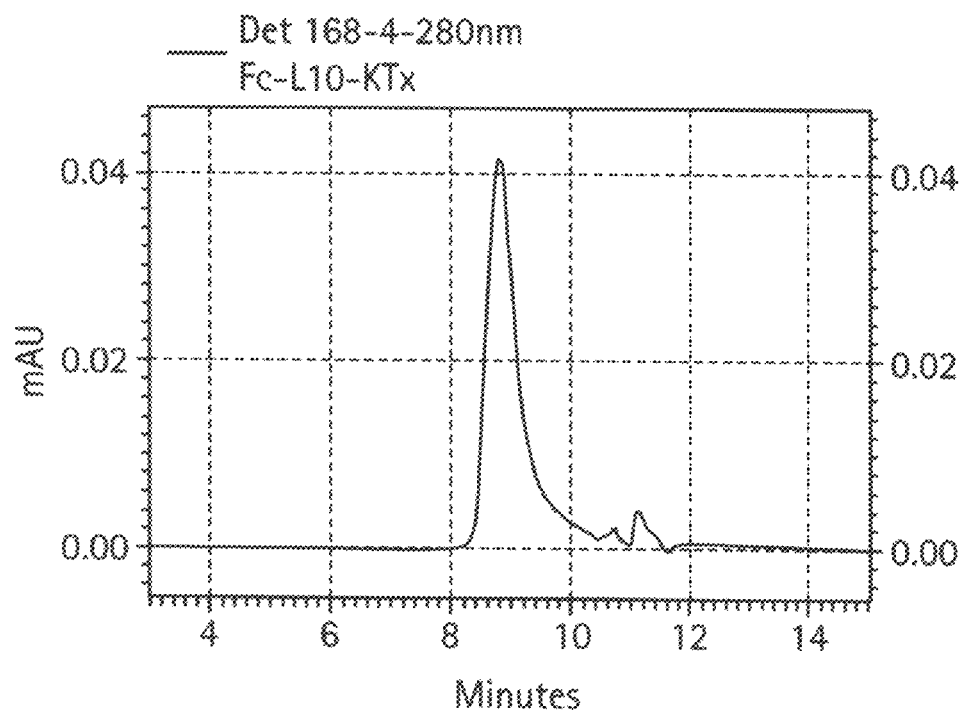

FIG. 28B shows size exclusion chromatography on 45 μg of purified Fc-L10-KTX1 injected on to a Phenomenex BioSep SEC 3000 column (7.8×300 mm) in 50 mM $NaH_2PO_4$, 250 mM NaCl, pH 6.9 at 1 ml/min observing the absorbance at 280 nm.

Figure 28C:
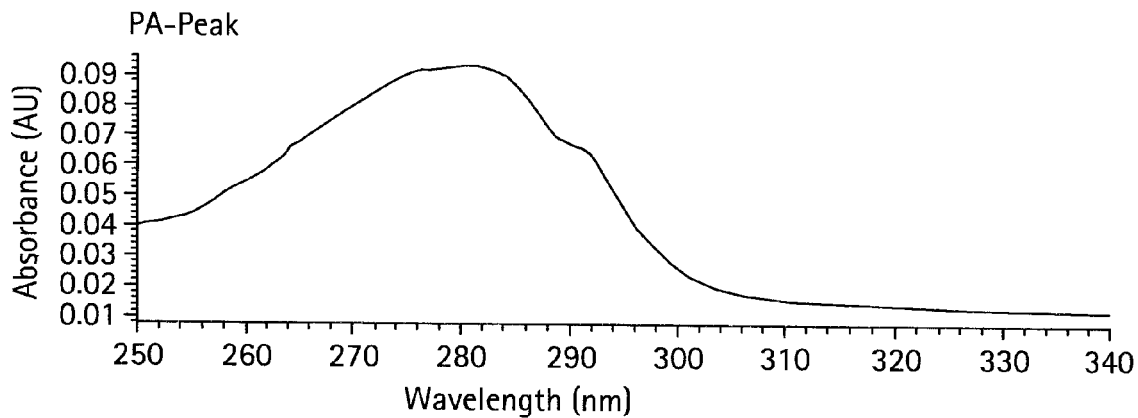

FIG. 28C shows a Spectral scan of 20 μl of the Fc-L10-KTX1 product diluted in 700 μl PBS (blanking buffer) using a Hewlett Packard 8453 spectrophotometer and a 1 cm path length quartz cuvette.

Figure 28D:
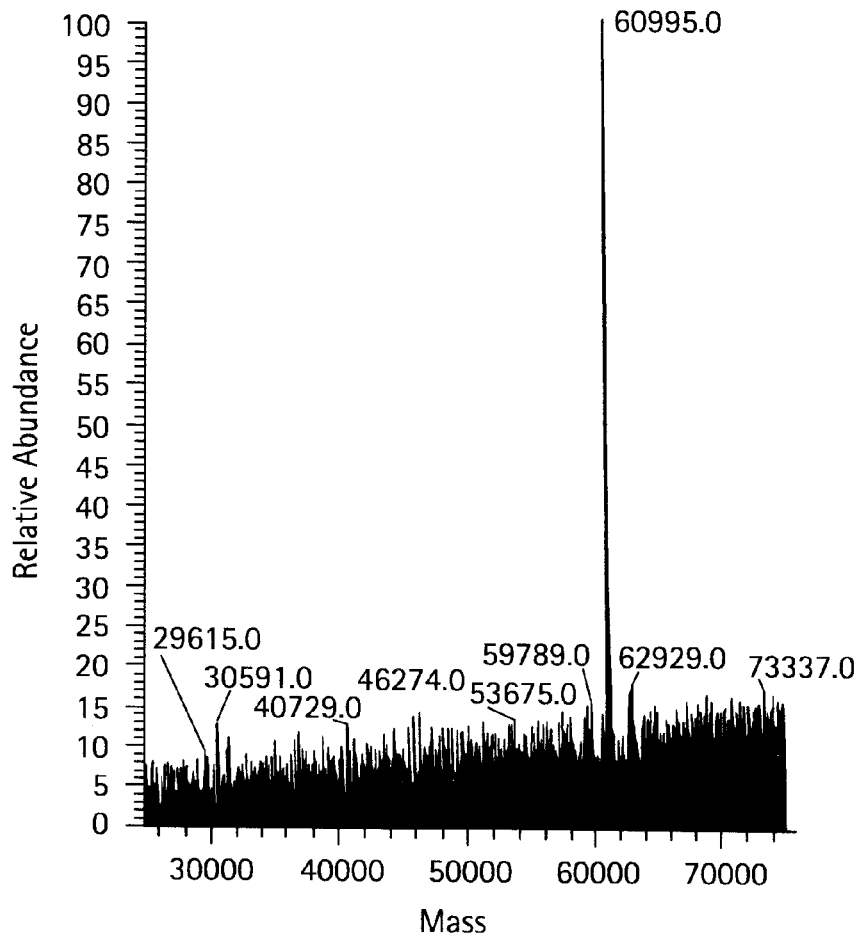

FIG. 28D shows a MALDI mass spectral analysis of the final sample of Fc-L10-KTX1 analyzed using a Voyager DE-RP time-of-flight mass spectrometer equipped with a nitrogen laser (337 nm, 3 ns pulse). The positive ion/linear mode was used, with an accelerating voltage of 25 kV. Each spectrum was produced by accumulating data from ~200 laser shots. External mass calibration was accomplished using purified proteins of known molecular masses.

Figure 29A:
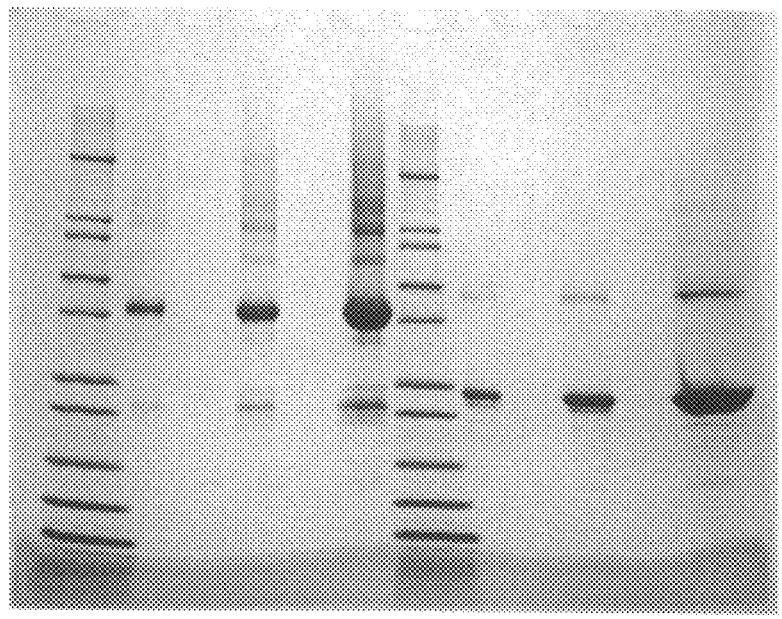

FIG. 29A shows a Coomassie brilliant blue stained tris-glycine 4-20% SDS-PAGE of Fc-L-AgTx2 purified and refolded from bacterial cells. Lane 1-12 are loaded as follows: Novex Mark 12 wide range protein standards, 0.5 μg product non-reduced, blank, 2.0 μg product non-reduced, blank, 10 μg product non-reduced, Novex Mark 12 wide range protein standards, 0.5 μg product reduced, blank, 2.0 μg product reduced, blank, and 10 μg product reduced, spectral scan of the purified material.

Figure 29B:
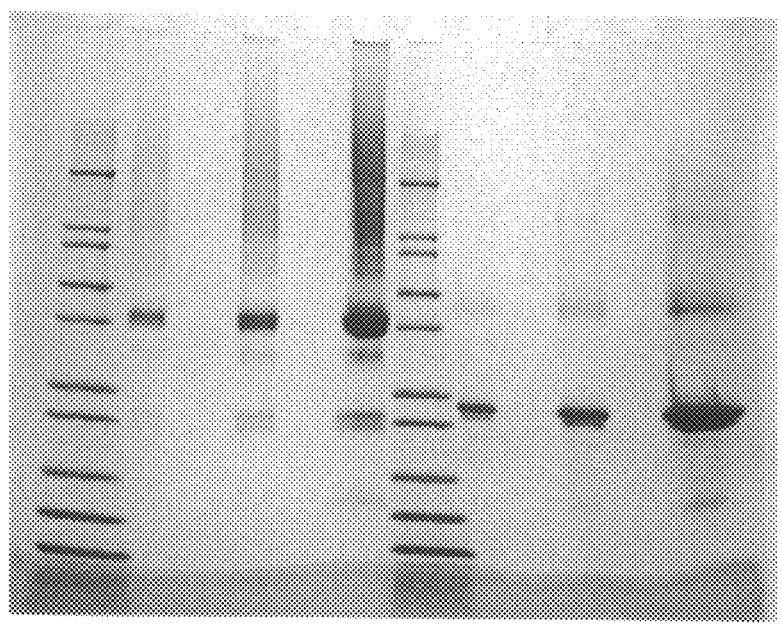

FIG. 29B shows a Coomassie brilliant blue stained tris-glycine 4-20% SDS-PAGE of Fc-L10-HaTx1 purified and refolded from bacterial cells. Lane 1-12 are loaded as follows: Novex Mark 12 wide range protein standards, 0.5 μg product non-reduced, blank, 2.0 μg product non-reduced, blank, 10 μg product non-reduced, Novex Mark 12 wide range protein standards, 0.5 μg product reduced, blank, 2.0 μg product reduced, blank, and 10 μg product reduced, spectral scan of the purified material.

Figure 29C:
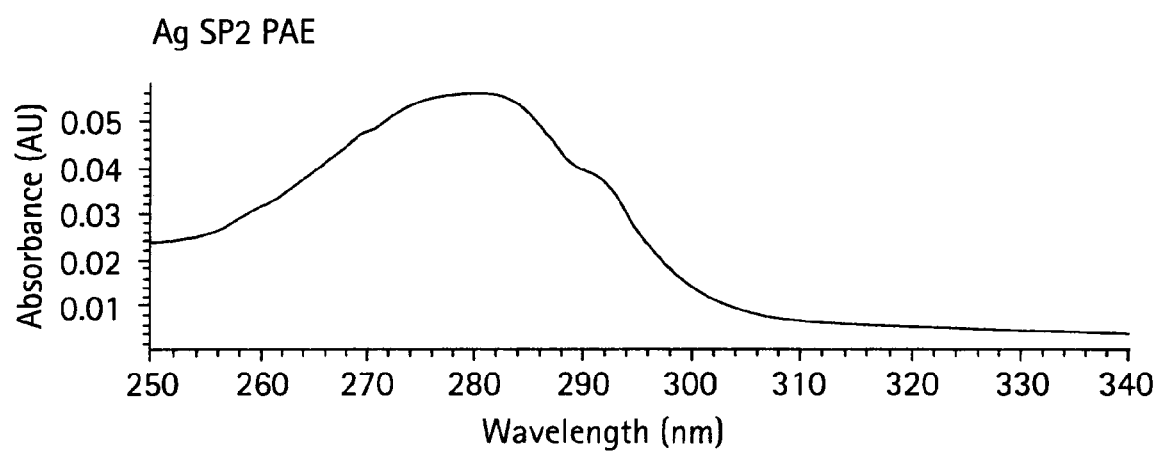

FIG. 29C shows a Spectral scan of 20 μl of the Fc-L10-AgTx2 product diluted in 700 μl PBS (blanking buffer) using a Hewlett Packard 8453 spectrophotometer and a 1 cm path length quartz cuvette.

Figure 29D:
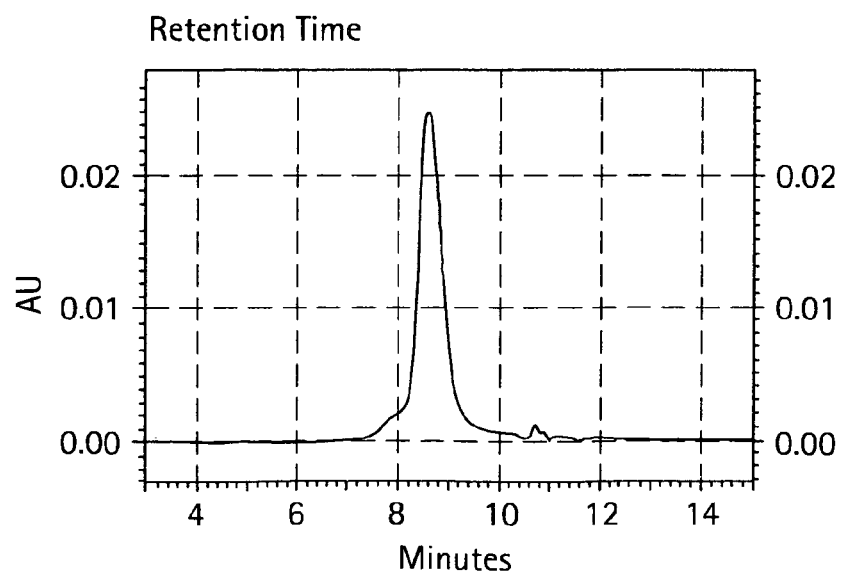

FIG. 29D shows the Size exclusion chromatography on 20 μg of the final Fc-L10-AgTx2 product injected on to a Phenomenex BioSep SEC 3000 column (7.8×300 mm) in 50 mM $NaH_2PO_4$, 250 mM NaCl, pH 6.9 at 1 ml/min observing the absorbance at 280 nm.

Figure 29E:
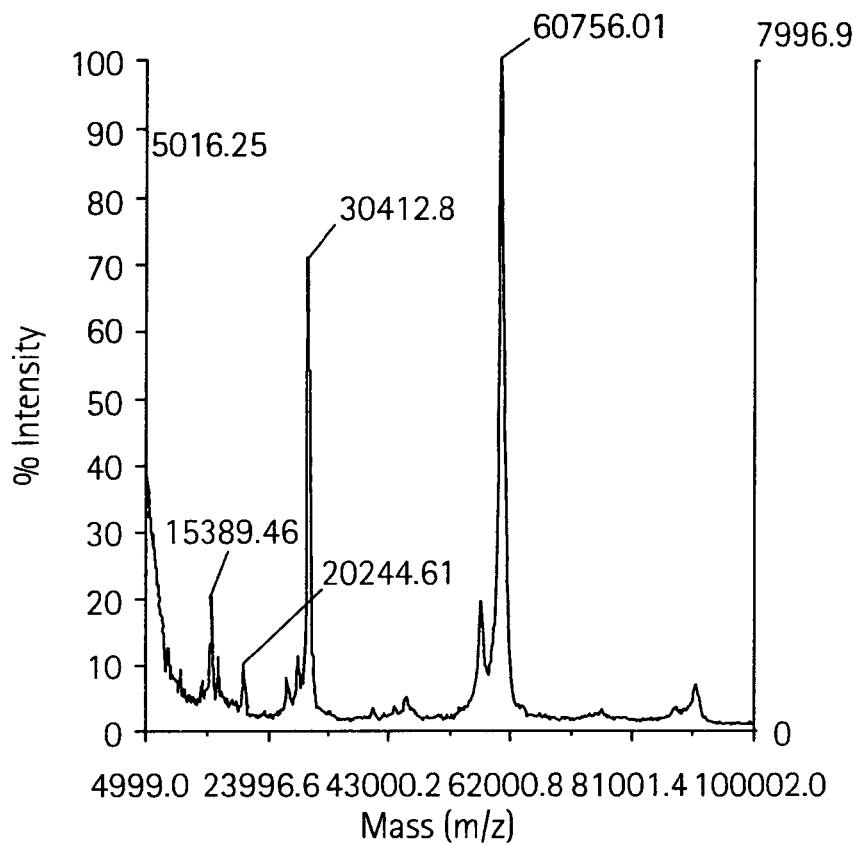

FIG. 29E shows a MALDI mass spectral analysis of the final sample of Fc-L10-AgTx2 analyzed using a Voyager DE-RP time-of-flight mass spectrometer equipped with a nitrogen laser (337 nm, 3 ns pulse). The positive ion/linear mode was used, with an accelerating voltage of 25 kV. Each spectrum was produced by accumulating data from about 200 laser shots. External mass calibration was accomplished using purified proteins of known molecular masses.

Figure 29F:
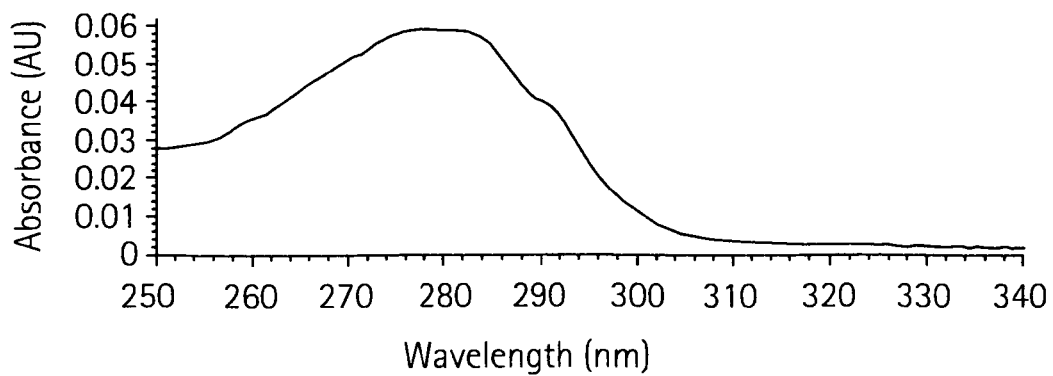

FIG. 29F shows a Spectral scan of 20 μl of the Fc-L10-HaTx1 product diluted in 700 μl PBS (blanking buffer) using a Hewlett Packard 8453 spectrophotometer and a 1 cm path length quartz cuvette.

Figure 29G:
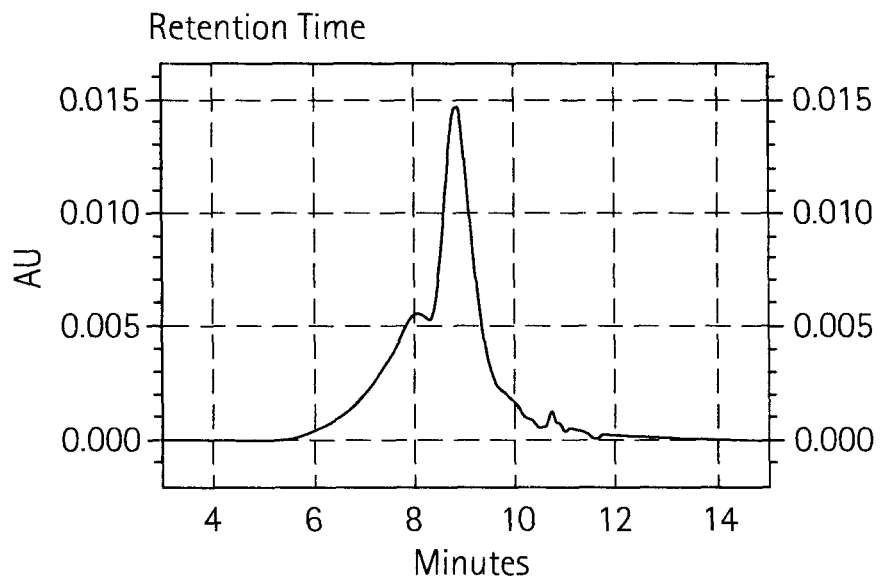

FIG. 29G shows the size exclusion chromatography on 20 μg of the final Fc-L10-HaTx1 product injected on to a Phenomenex BioSep SEC 3000 column (7.8×300 mm) in 50 mM $NaH_2PO_4$, 250 mM NaCl, pH 6.9 at 1 ml/min observing the absorbance at 280 nm.

Figure 29H:
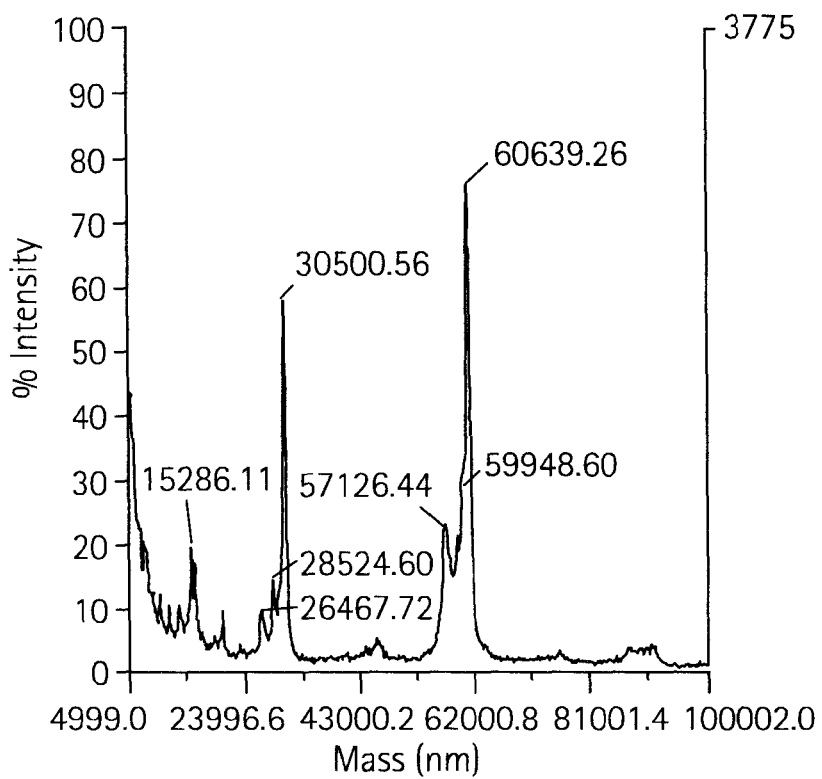

FIG. 29H shows a MALDI mass spectral analysis of the final sample of Fc-L10-HaTx1 analyzed using a Voyager DE-RP time-of-flight mass spectrometer equipped with a nitrogen laser (337 nm, 3 ns pulse). The positive ion/linear mode was used, with an accelerating voltage of 25 kV. Each spectrum was produced by accumulating data from ~200 laser shots. External mass calibration was accomplished using purified proteins of known molecular masses.

Figure 30A:
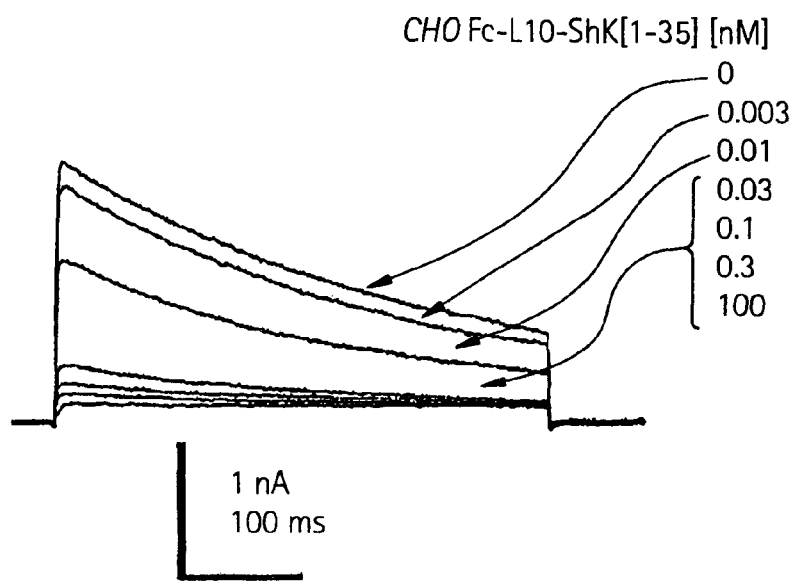

FIG. 30A shows Fc-L10-ShK[1-35] purified from CHO cells produces a concentration dependent block of the outward potassium current recorded from HEK293 cell stably expressing the human Kv1.3 channel.

Figure 30B:
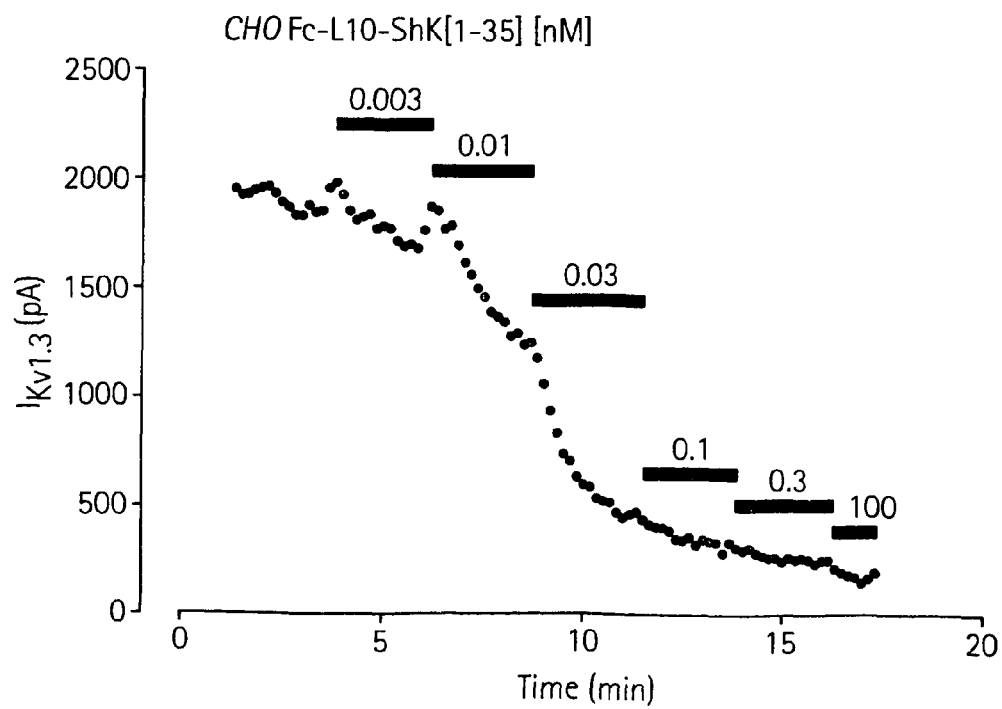

FIG. 30B shows the time course of potassium current block by Fc-L10-ShK[1-35] at various concentrations. The IC50 was estimated to be 15±2 pM (n=4 cells).

Figure 30C:
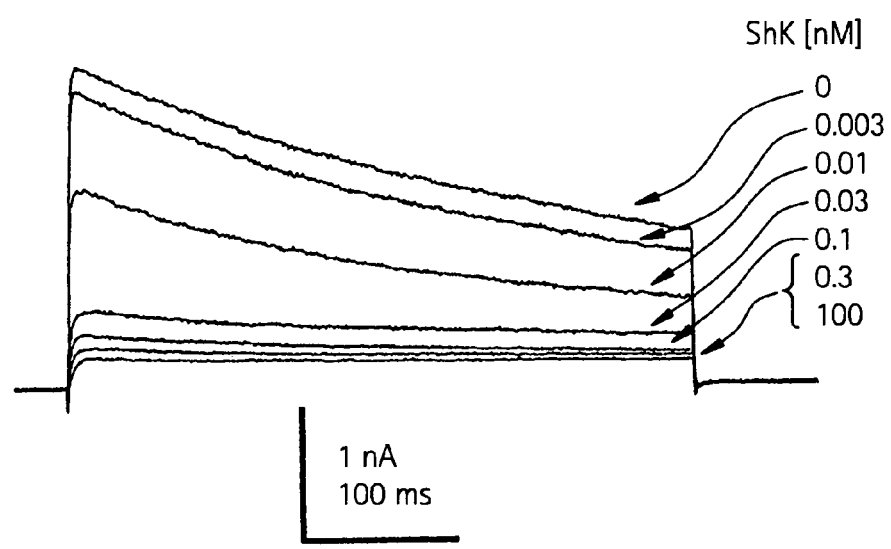

FIG. 30C shows synthetic ShK[1-35] (also referred to as "ShK" alone) produces a concentration dependent block of the outward potassium current recorded from HEK293 cell stably expressing human Kv1.3 channel.

Figure 30D:
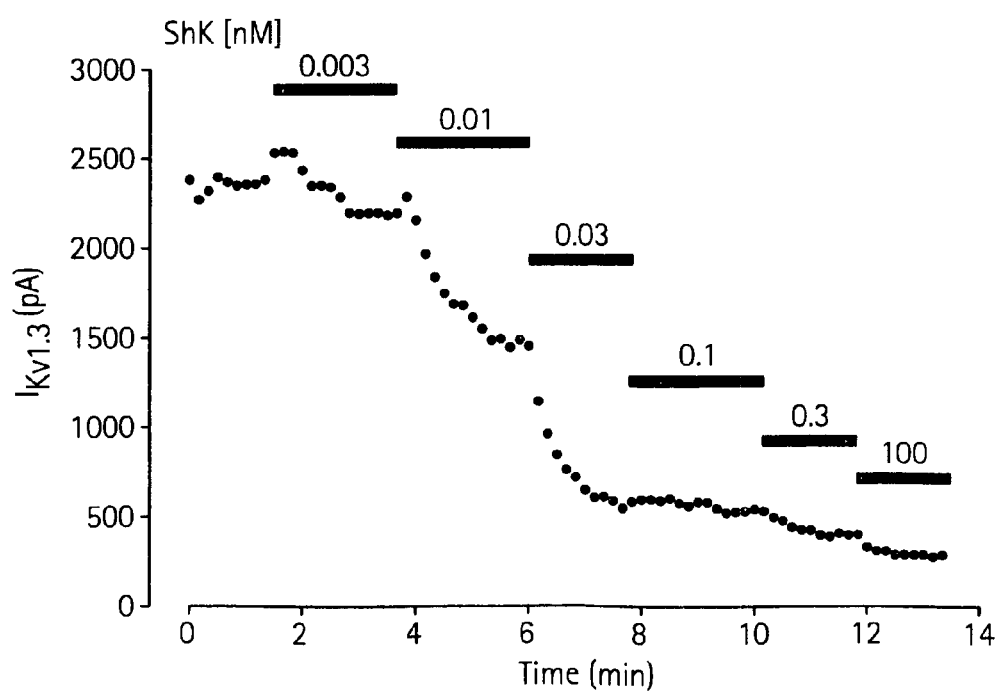

FIG. 30D shows the time course of ShK[1-35] block at various concentrations. The IC50 for ShK was estimated to be 12±1 pM (n=4 cells).

Figure 31A:
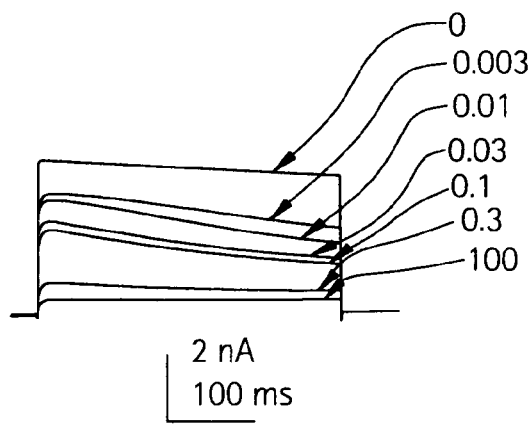

FIG. 31A shows synthetic peptide analog ShK[2-35] producing a concentration dependent block of the outward potassium current as recorded from HEK293 cells stably expressing human Kv1.3 channel with an IC50 of 49±5 pM (n=3 cells).

Figure 31B:
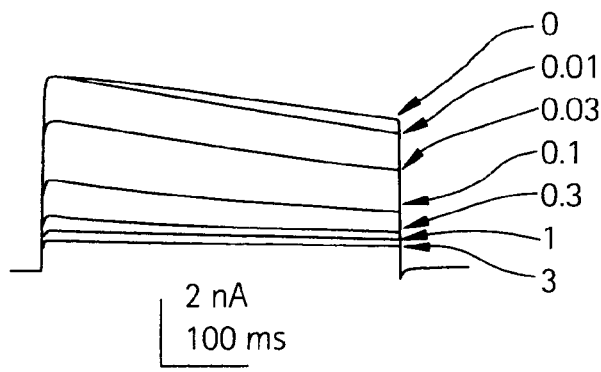

FIG. 31B shows the CHO-derived Fc-L10-ShK[2-35] peptibody producing a concentration dependent block of the outward potassium current as recorded from HEK293 cell stably expressing human Kv1.3 channel with an IC50 of 115±18 pM (n=3 cells).

Figure 31C:
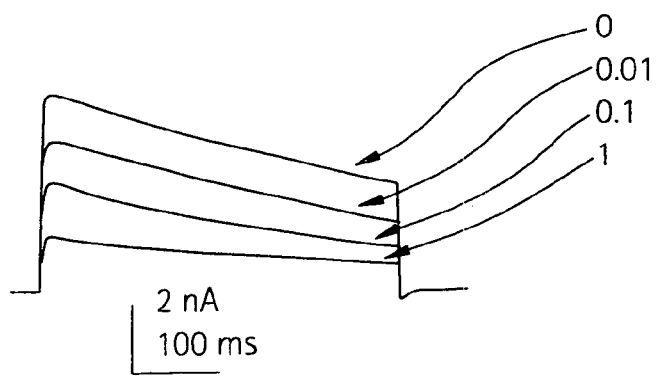

FIG. 31C shows the Fc-L5-ShK[2-35] peptibody produces a concentration dependent block of the outward potassium current recorded from HEK293 cell stably expressing human Kv1.3 channel with an IC50 of 100 pM (n=3 cells).

Figure 32A:
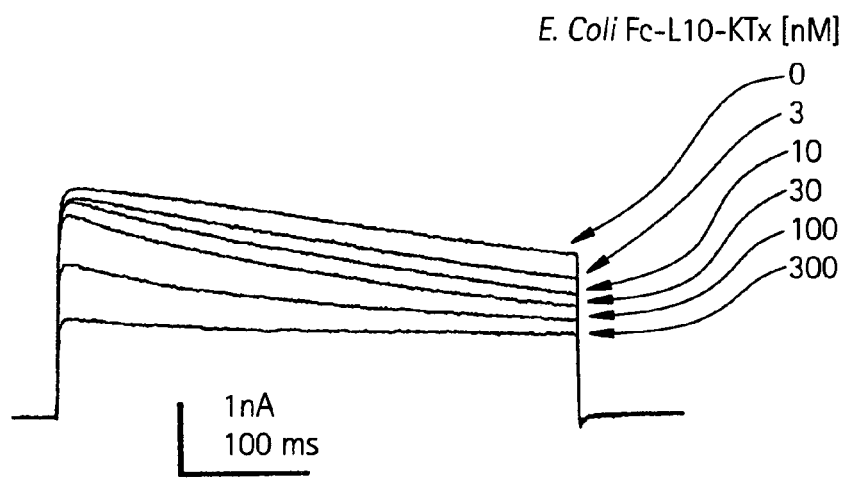

FIG. 32A shows Fc-L-KTX1 peptibody purified from bacterial cells producing a concentration dependent block of the outward potassium current as recorded from HEK293 cell stably expressing human Kv1.3 channel.

Figure 32B:
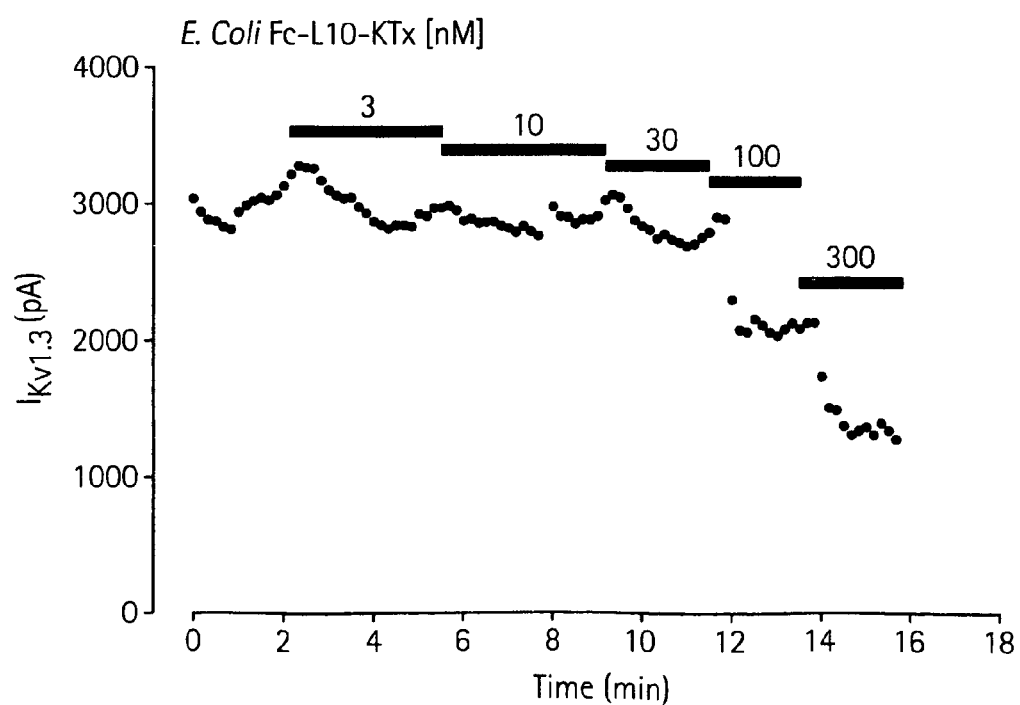

FIG. 32B shows the time course of potassium current block by Fc-L10-KTX1 at various concentrations.

Figure 33A:
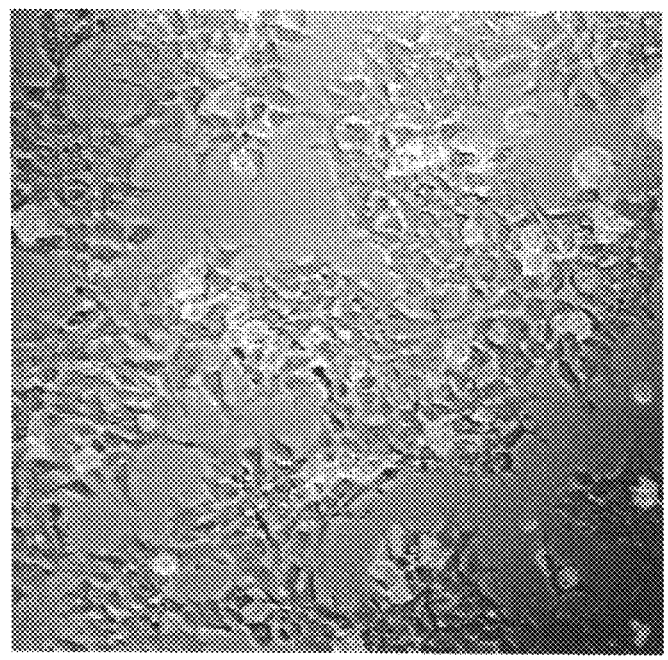
Figure 33B:
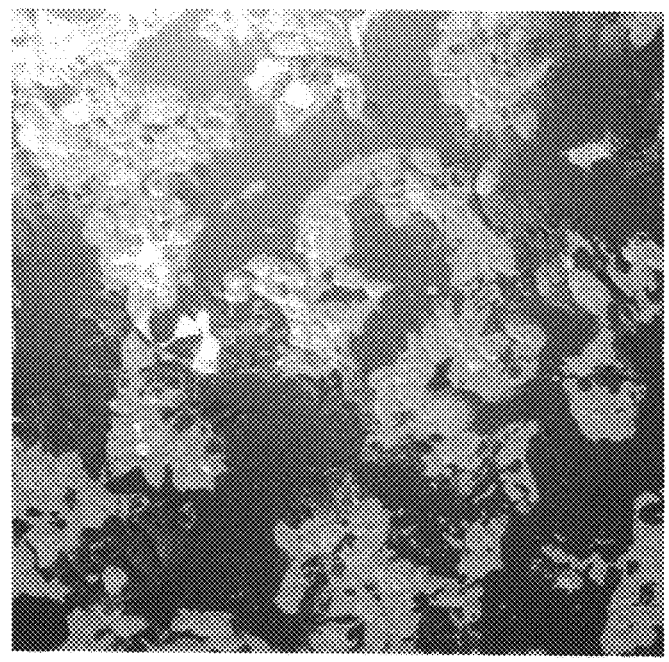

FIG. 33 shows by immunohistochemistry that CHO-derived Fc-L10-ShK[1-35] peptibody stains HEK 293 cells stably transfected with human Kv1.3 (FIG. 33A), whereas untransfected HEK 293 cells are not stained with the peptibody (FIG. 33B).

Figure 34A:
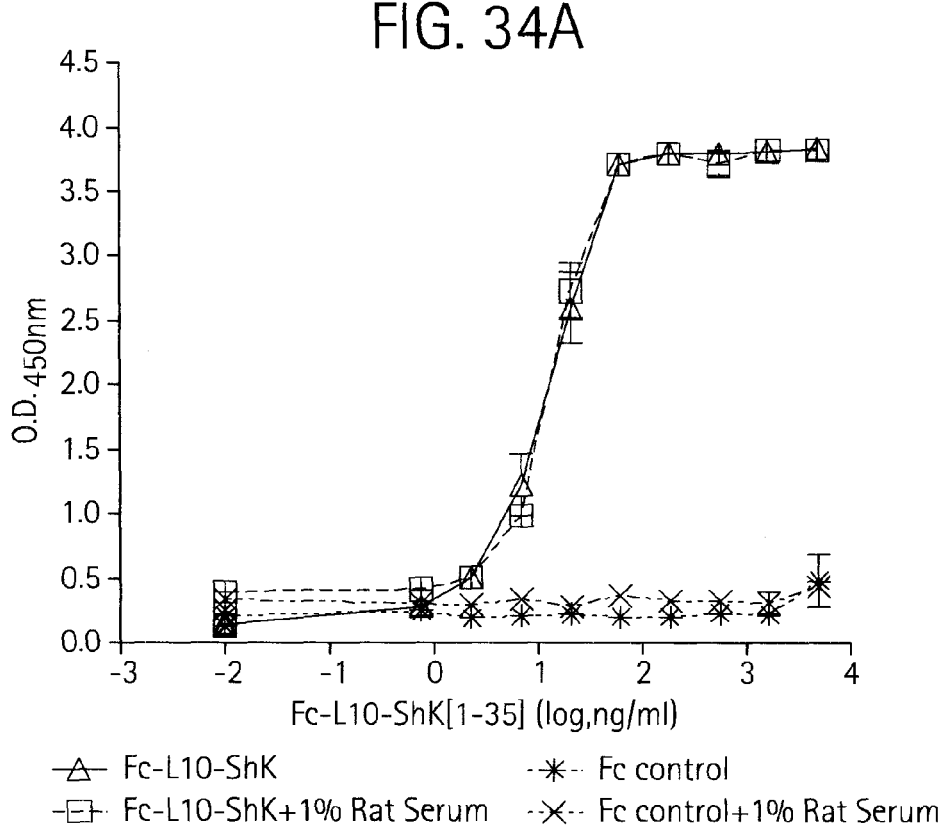
Figure 34B:
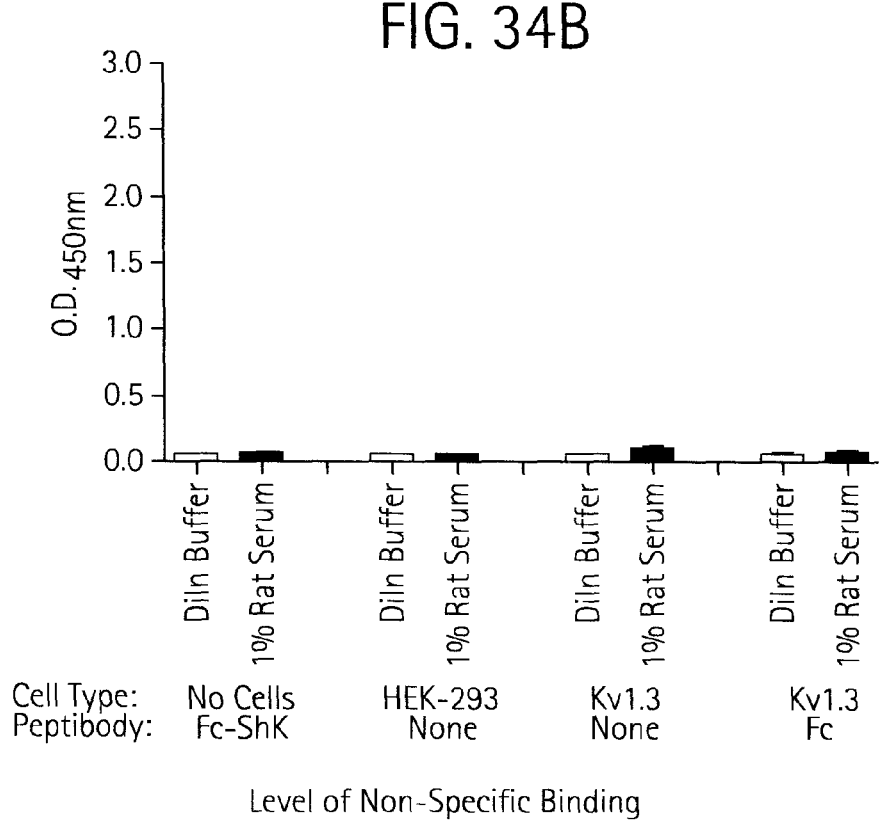

FIG. 34 shows results of an enzyme-immunoassay using fixed HEK 293 cells stably transfected with human Kv1.3. FIG. 34A shows the CHO-derived Fc-L10-ShK[1-35] (referred to here simply as "Fc-L10-ShK") peptibody shows a dose-dependent increase in response, whereas the CHO-Fc control ("Fc control") does not. FIG. 34B shows the Fc-L10-ShK[1-35] peptibody (referred to here as "Fc-ShK") does not elicit a response from untransfected HEK 293 cells using similar conditions and also shows other negative controls.

Figure 35A:
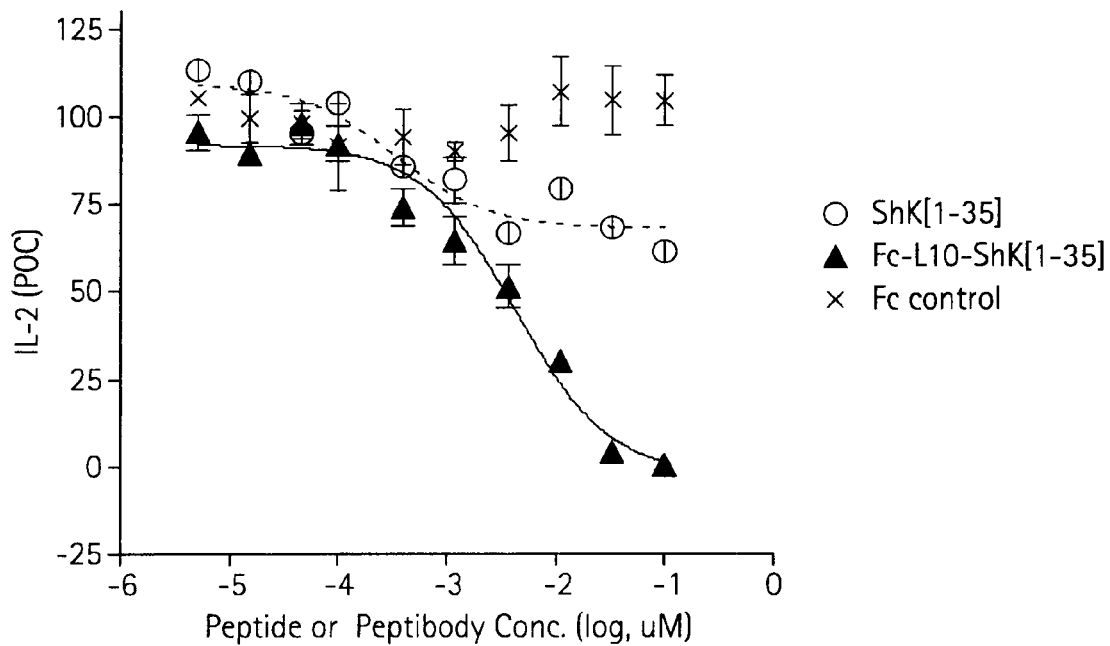
Figure 35B:
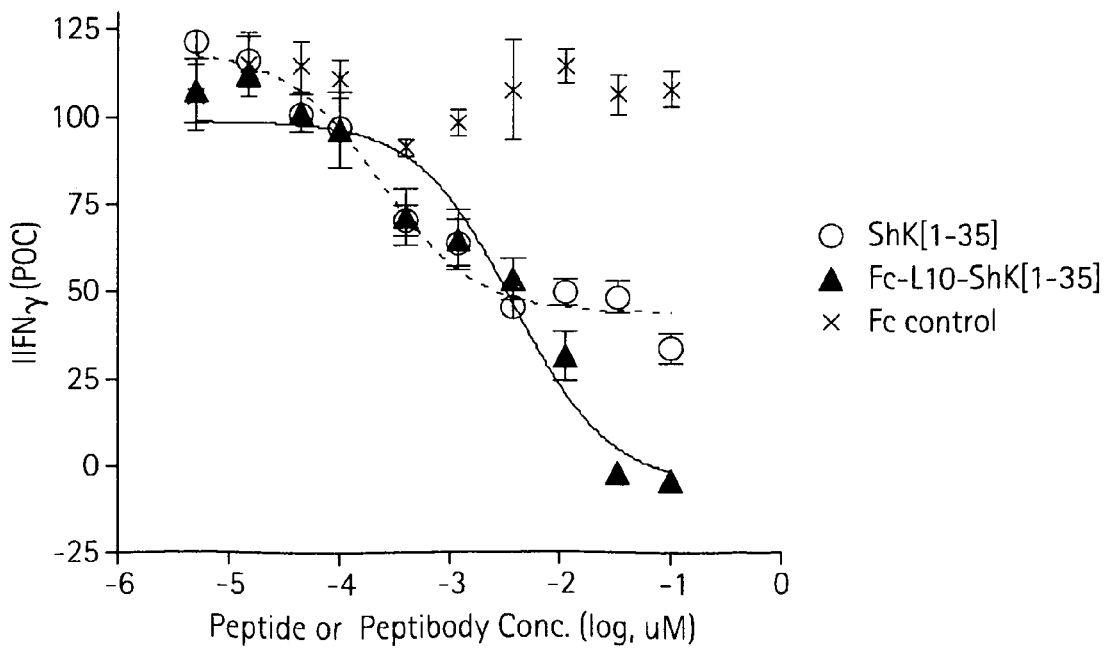

FIG. 35 shows the CHO-derived Fc-L10-ShK[1-35] peptibody shows a dose-dependent inhibition of IL-2 (FIG. 35A) and IFNγ (FIG. 35B) production from PMA and αCD3 antibody stimulated human PBMCs. The peptibody shows a novel pharmacology exhibiting a complete inhibition of the response, whereas the synthetic ShK[1-35] peptide alone shows only a partial inhibition.

FIG. 36 shows the mammalian-derived Fc-L10-ShK[1-35] peptibody inhibits T cell proliferation ($^3$H-thymidine incorporation) in human PBMCs from two normal donors stimulated with antibodies to CD3 and CD28. FIG. 36A shows the response of donor 1 and FIG. 36B the response of donor 2. Pre-incubation with the anti-CD32 (FcgRII) blocking antibody did not alter the sensitivity toward the peptibody.

Figure 37A:
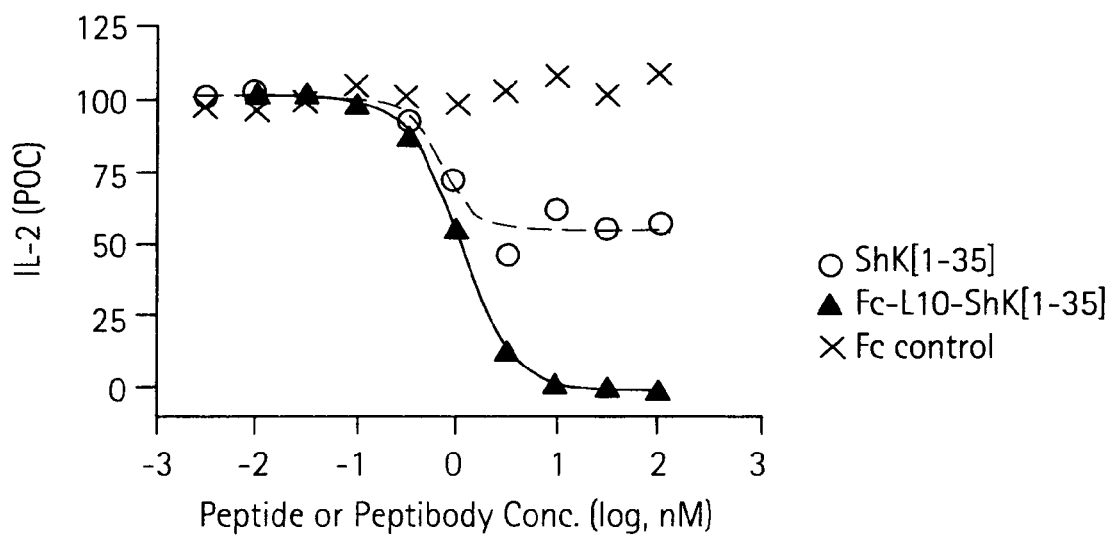
Figure 37B:
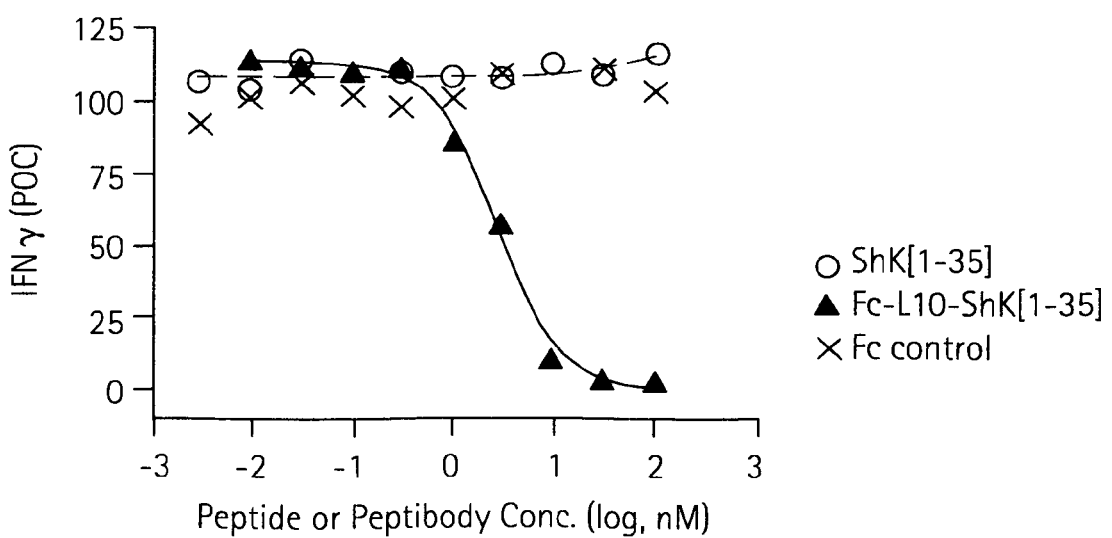

FIG. 37 shows the purified CHO-derived Fc-L10-ShK[1-35] peptibody causes a dose-dependent inhibition of IL-2 (FIG. 37A) and IFNγ (FIG. 37B) production from αCD3 and αCD28 antibody stimulated human PBMCs.

Figure 38A:
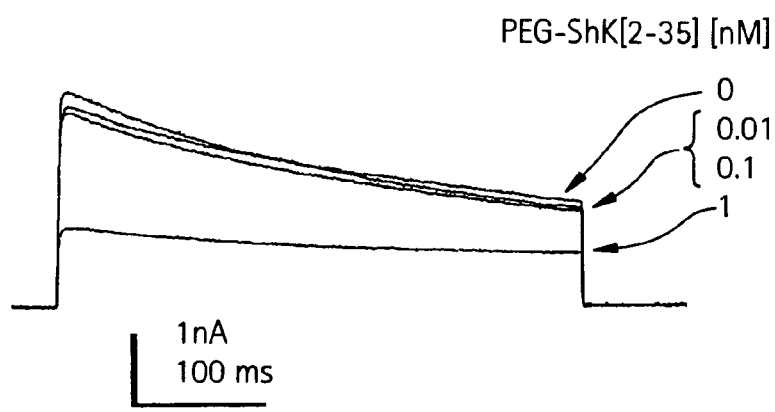
Figure 38B:
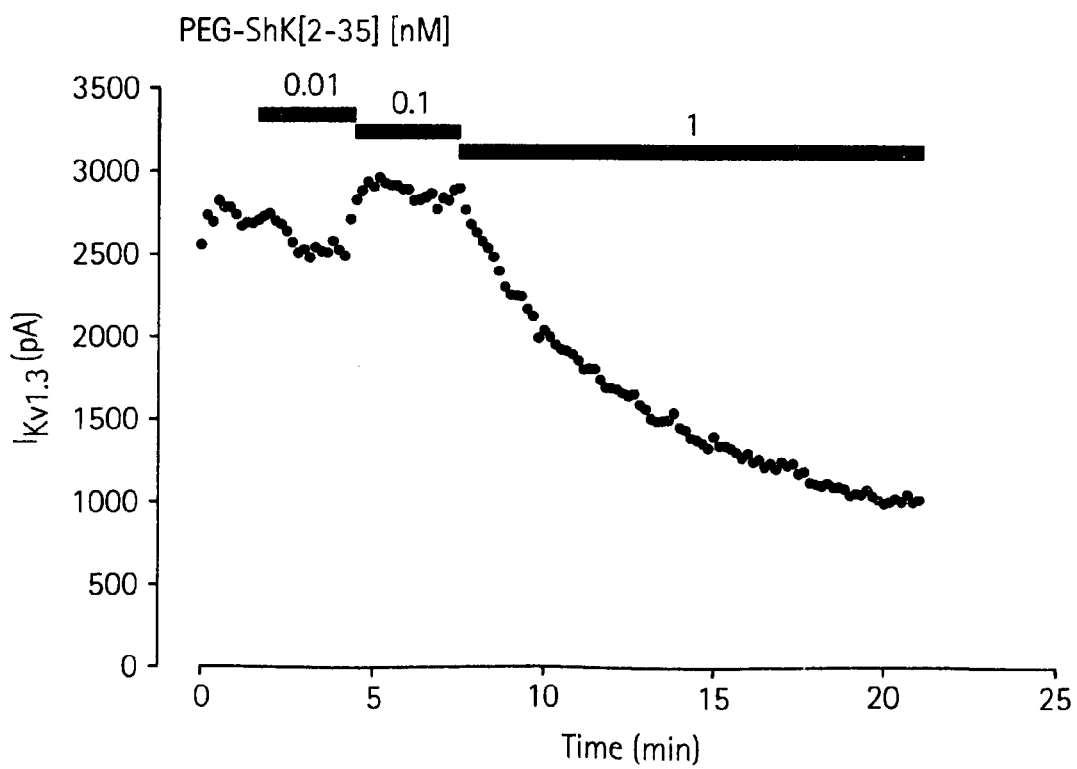

FIG. 38A shows the PEGylated ShK[2-35] synthetic peptide produces a concentration dependent block of the outward potassium current recorded from HEK293 cell stably expressing human Kv1.3 channel and the time course of potassium current block at various concentrations is shown in FIG. 38B.

Figure 39A:
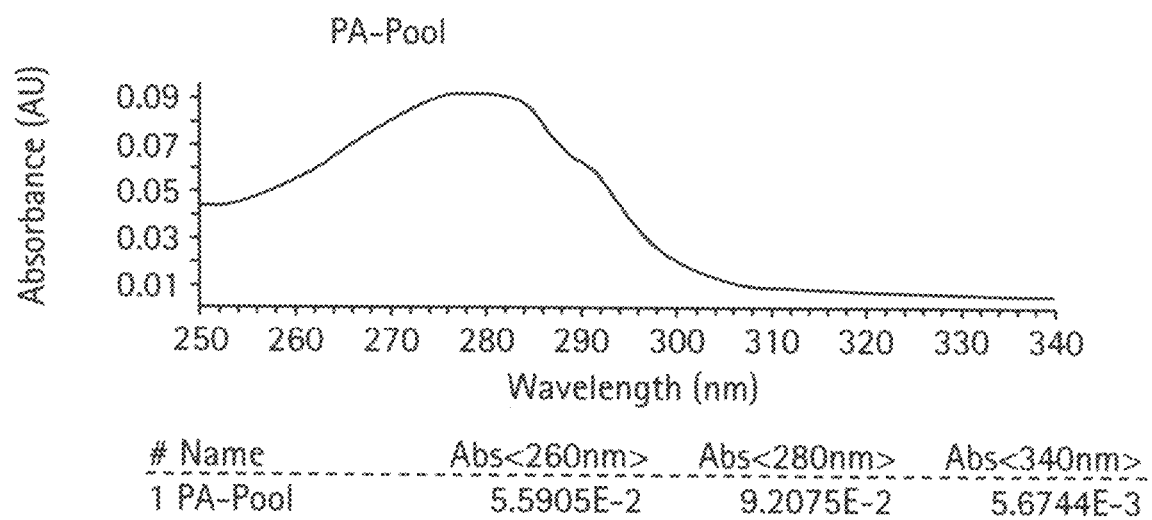

FIG. 39A shows a spectral scan of 50 μl of the Fc-L10-ShK (1-35) product diluted in 700 μl PBS (blanking buffer) using a Hewlett Packard 8453 spectrophotometer and a 1 cm path length quartz cuvette.

Figure 39B:
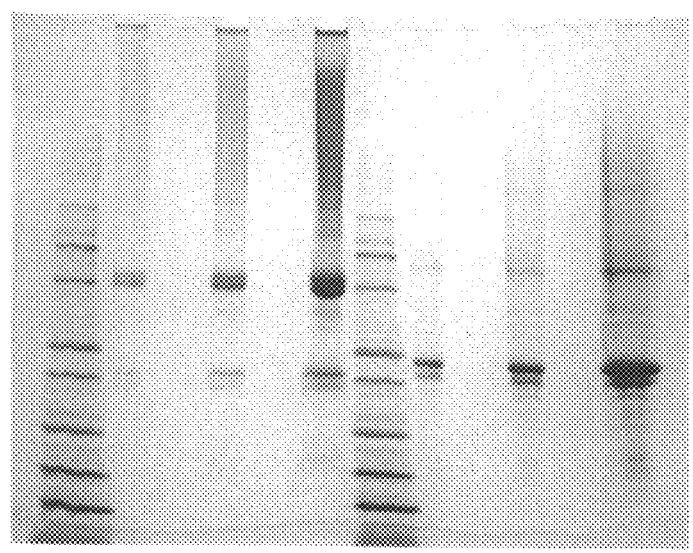

FIG. 39B shows a Coomassie brilliant blue stained tris-glycine 4-20% SDS-PAGE of the final Fc-L10-ShK(1-35) product. Lane 1-12 are loaded as follows: Novex Mark 12 wide range protein standards, 0.5 μg product non-reduced, blank, 2.0 μg product non-reduced, blank, 10 μg product non-reduced, Novex Mark 12 wide range protein standards, 0.5 μg product reduced, blank, 2.0 μg product reduced, blank, and 10 μg product reduced.

Figure 39C:
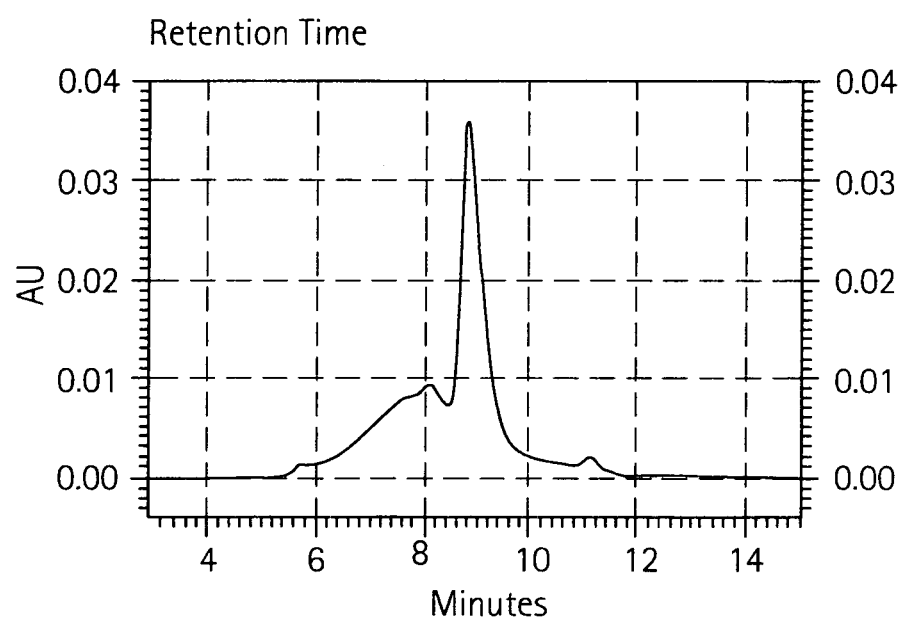

FIG. 39C shows the Size exclusion chromatography on 50 μg of the final Fc-L10-ShK(1-35) product injected on to a Phenomenex BioSep SEC 3000 column (7.8×300 mm) in 50 mM NaH$_2$PO$_4$, 250 mM NaCl, pH 6.9 at 1 ml/min observing the absorbance at 280 nm.

Figure 40A:
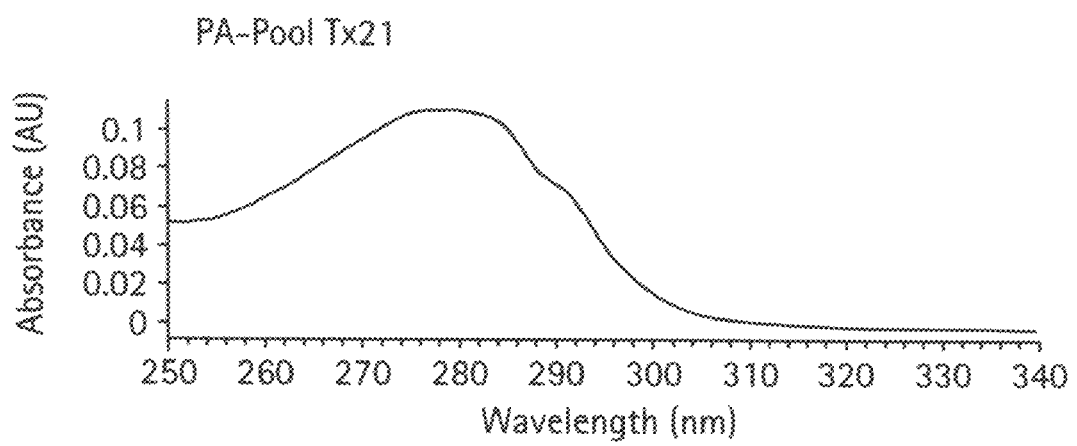

FIG. 40A shows a Spectral scan of 20 μl of the Fc-L10-ShK(2-35) product diluted in 700 μl PBS (blanking buffer) using a Hewlett Packard 8453 spectrophotometer and a 1 cm path length quartz cuvette.

Figure 40B:
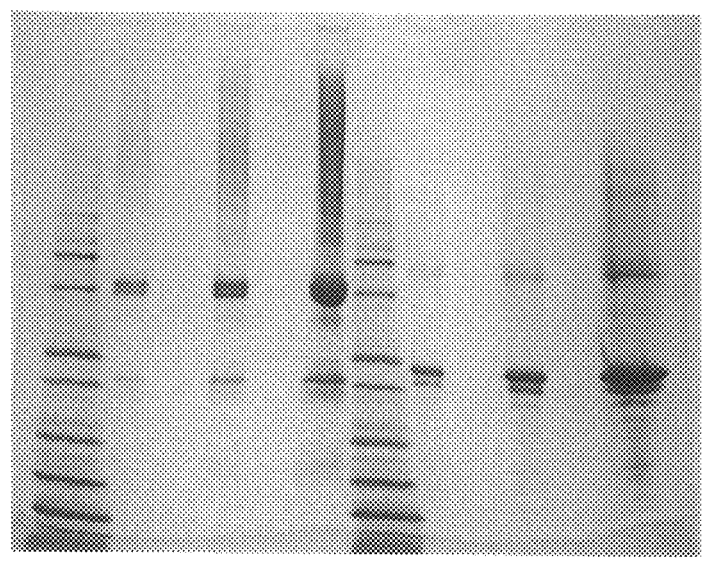

FIG. 40B shows a Coomassie brilliant blue stained tris-glycine 4-20% SDS-PAGE of the final Fc-L10-ShK(2-35) product. Lanes 1-12 are loaded as follows: Novex Mark 12 wide range protein standards, 0.5 μg product non-reduced, blank, 2.0 μg product non-reduced, blank, 10 μg product non-reduced, Novex Mark 12 wide range protein standards, 0.5 μg product reduced, blank, 2.0 μg product reduced, blank, and 10 μg product reduced.

Figure 40C:
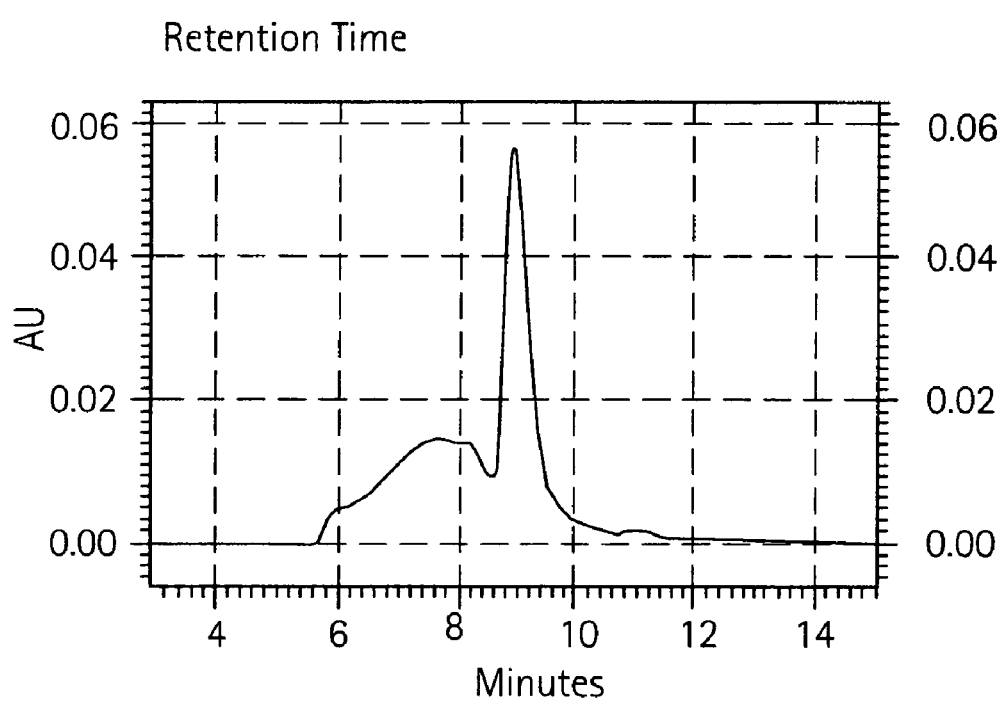

FIG. 40C shows the size exclusion chromatography on 50 μg of the final Fc-L10-ShK(2-35) product injected on to a Phenomenex BioSep SEC 3000 column (7.8×300 mm) in 50 mM NaH$_2$PO$_4$, 250 mM NaCl, pH 6.9 at 1 ml/min observing the absorbance at 280 nm.

Figure 40D:
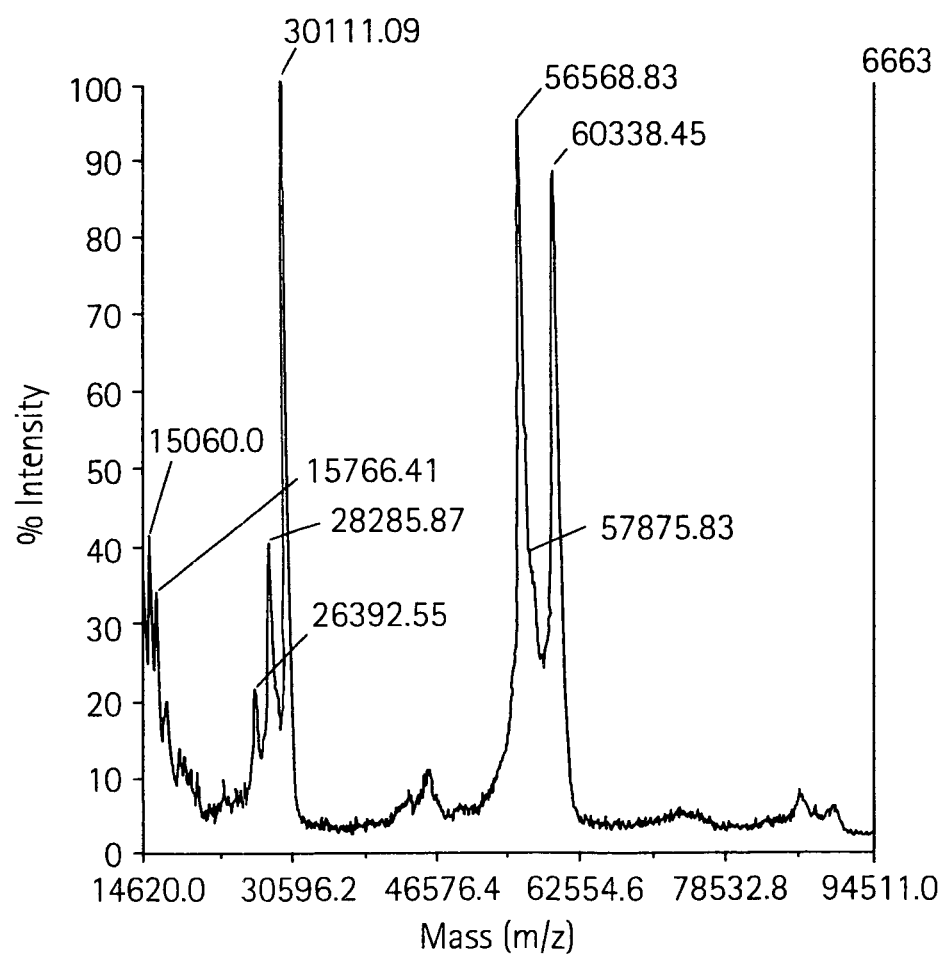

FIG. 40D shows a MALDI mass spectral analysis of the final sample of Fc-L10-ShK(2-35) analyzed using a Voyager DE-RP time-of-flight mass spectrometer equipped with a nitrogen laser (337 nm, 3 ns pulse). The positive ion/linear mode was used, with an accelerating voltage of 25 kV. Each spectrum was produced by accumulating data from ~200 laser shots. External mass calibration was accomplished using purified proteins of known molecular masses.

Figure 41A:
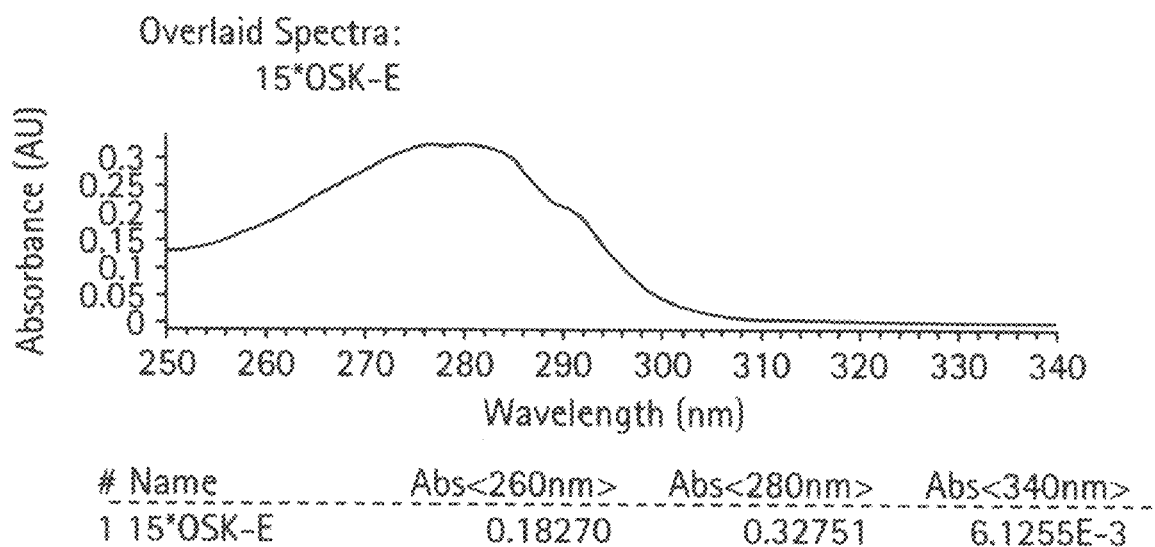

FIG. 41A shows spectral scan of 50 μl of the Fc-L10-OSK1 product diluted in 700 μl Formulation Buffer using a Hewlett Packard 8453 spectrophotometer and a 1 cm path length quartz cuvette.

Figure 41B:
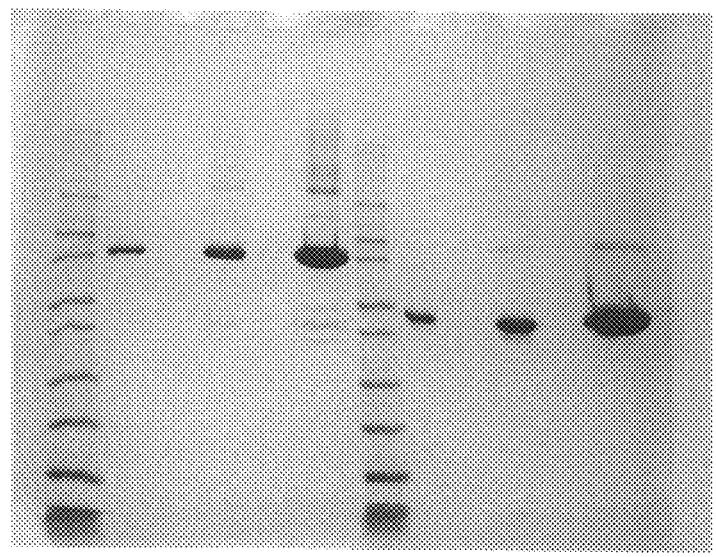

FIG. 41B shows Coomassie brilliant blue stained tris-glycine 4-20% SDS-PAGE of the final Fc-L10-OSK1 product. Lanes 1-12 are loaded as follows: Novex Mark 12 wide range protein standards, 0.5 μg product non-reduced, blank, 2.0 μg product non-reduced, blank, 10 μg product non-reduced, Novex Mark 12 wide range protein standards, 0.5 μg product reduced, blank, 2.0 μg product reduced, blank, and 10 μg product reduced.

Figure 41C:
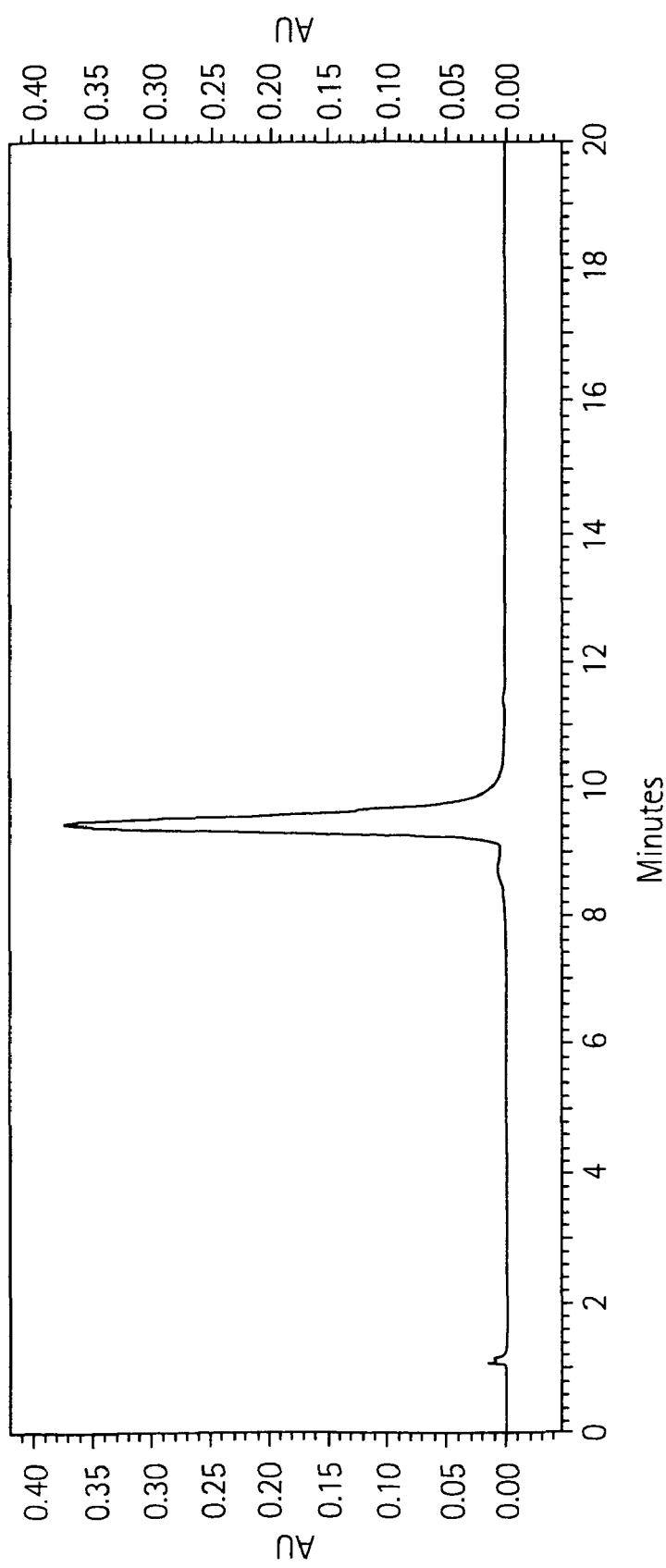

FIG. 41C shows size exclusion chromatography on 123 μg of the final Fc-L10-OSK1 product injected on to a Phenomenex BioSep SEC 3000 column (7.8×300 mm) in 50 mM NaH$_2$PO$_4$, 250 mM NaCl, pH 6.9 at 1 ml/min observing the absorbance at 280 nm.

Figure 41D:
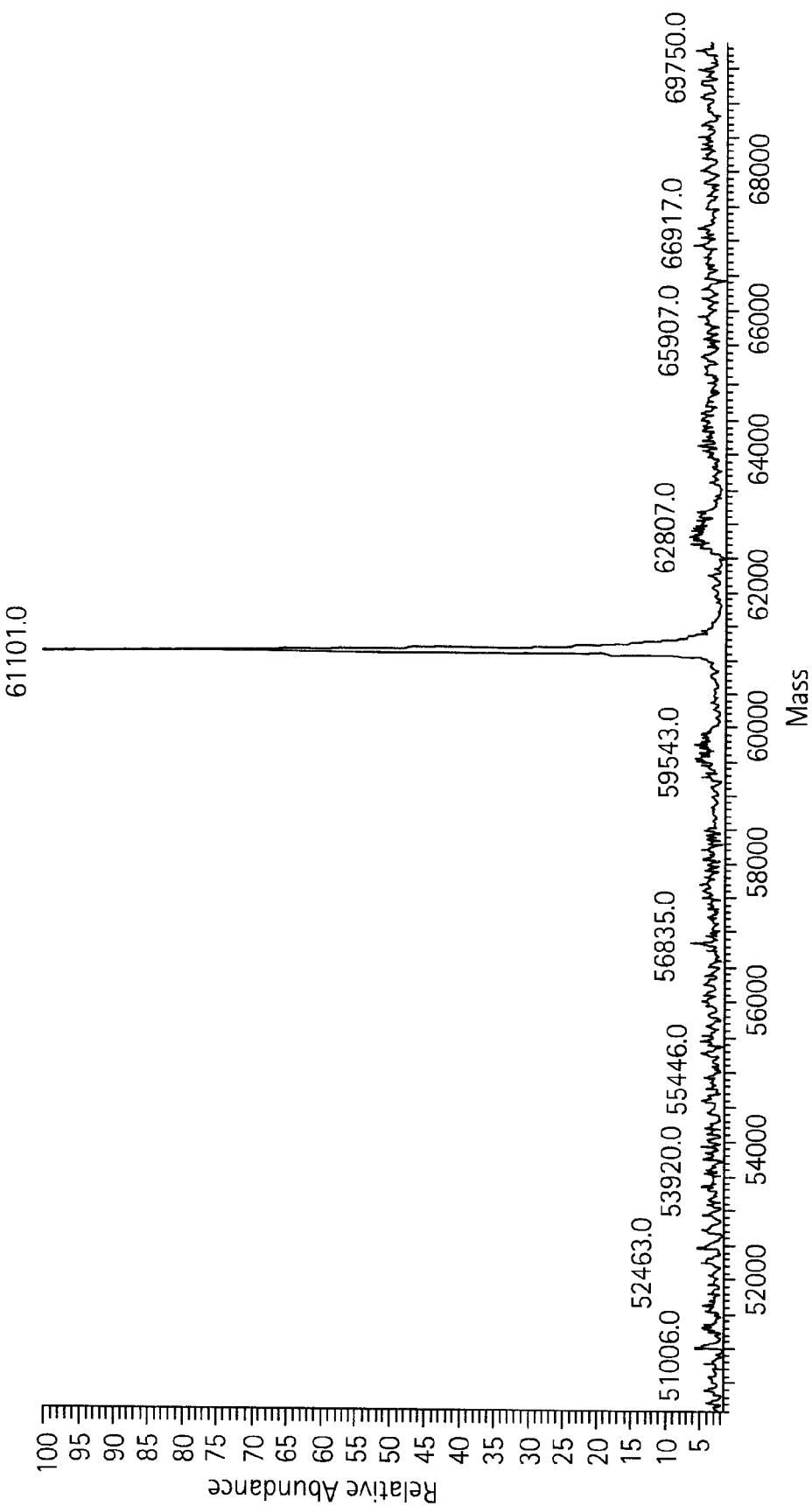

FIG. 41D shows liquid chromatography—mass spectral analysis of approximately 4 μg of the final Fc-L10-OSK1 sample using a Vydac C$_4$ column with part of the effluent directed into a LCQ ion trap mass spectrometer. The mass spectrum was deconvoluted using the Bioworks software provided by the mass spectrometer manufacturer.

FIG. 42A-B shows nucleotide and amino acid sequences (SEQ ID NO: 1040 and SEQ ID NO: 1041, respectively) of Fc-L10-OSK1.

FIG. 43A-B shows nucleotide and amino acid sequences (SEQ ID NO: 1042 and SEQ ID NO: 1043, respectively) of Fc-L10-OSK1[K7S].

FIG. 44A-B shows nucleotide and amino acid sequences (SEQ ID NO: 1044 and SEQ ID NO: 1045, respectively) of Fc-L10-OSK1[E16K,K20D].

FIG. 45A-B shows nucleotide and amino acid sequences (SEQ ID NO: 1046 and SEQ ID NO: 1047, respectively) of Fc-L10-OSK1[K7S,E16K,K20D].

Figure 46:
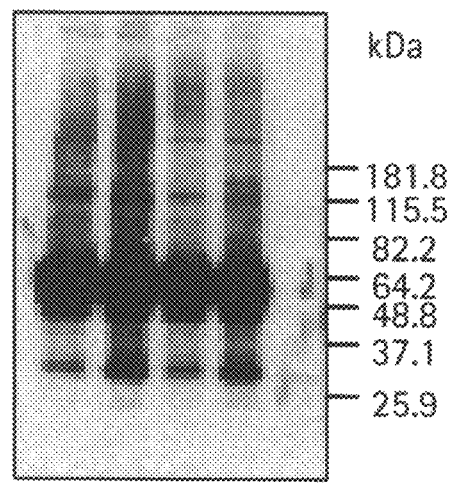
Figure 47:
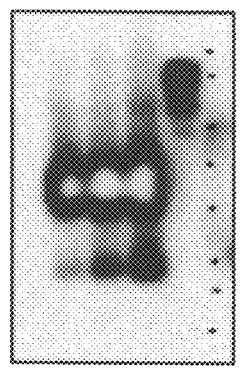

FIG. 46 shows a Western blot (from tris-glycine 4-20% SDS-PAGE) with anti-human Fc antibodies. Lanes 1-6 were loaded as follows: 15 μl of Fc-L10-OSK1[K7S,E16K,K20D]; 15 μl of Fc-L10-OSK1[E16K,K20D]; 15 μl of Fc-L10-OSK1[K7S]; 15 μl of Fc-L10-OSK1; 15 μl of "No DNA" control; molecular weight markers FIG. 47 shows a Western blot (from tris-glycine 4-20% SDS-PAGE) with anti-human Fc antibodies. Lanes 1-5 were loaded as follows: 2 μl of Fc-L10-OSK1; 5 μl of Fc-L10-OSK1; 10 μg of Fc-L10-OSK1; 20 ng Human IgG standard; molecular weight markers.

Figure 48:
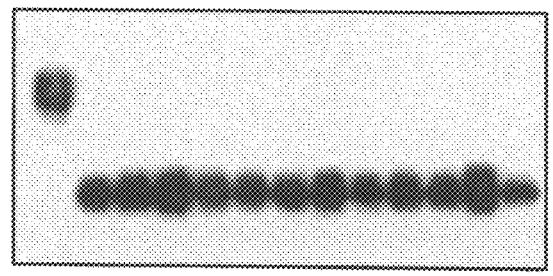

FIG. 48 shows a Western blot (from tris-glycine 4-20% SDS-PAGE) with anti-human Fc antibodies. Lanes 1-13 were loaded as follows: 20 ng Human IgG standard; D1; C3; C2; B6; B5; B2; B1; A6; A5; A4; A3; A2 (5 μl of clone-conditioned medium loaded in lanes 2-13).

Figure 49A:
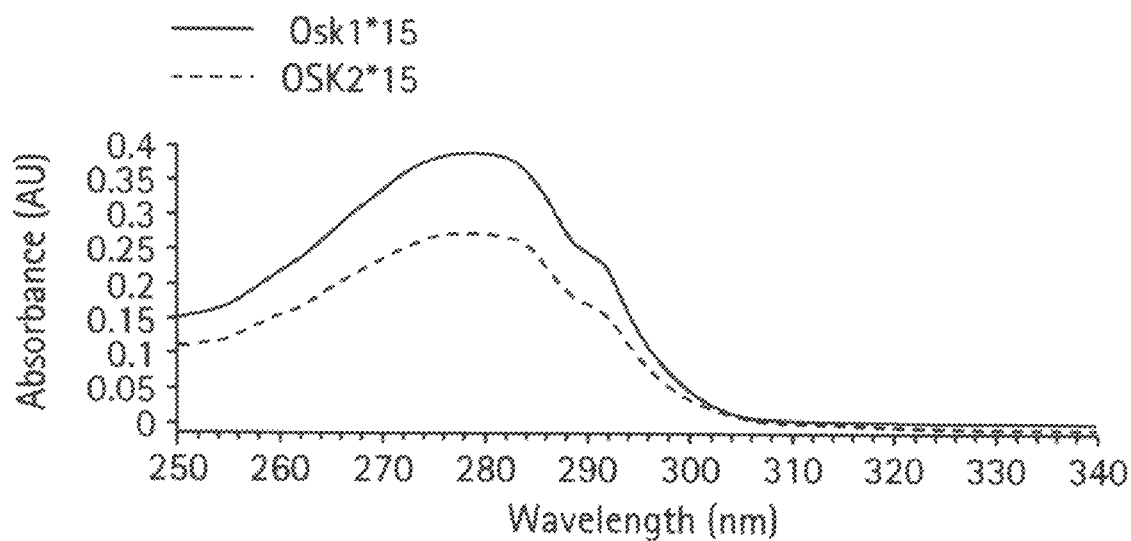

FIG. 49A shows a spectral scan of 50 μl of the Fc-L10-OsK1 product diluted in 700 μl PBS (blanking buffer) using a Hewlett Packard 8453 spectrophotometer and a 1 cm path length quartz cuvette.

Figure 49B:
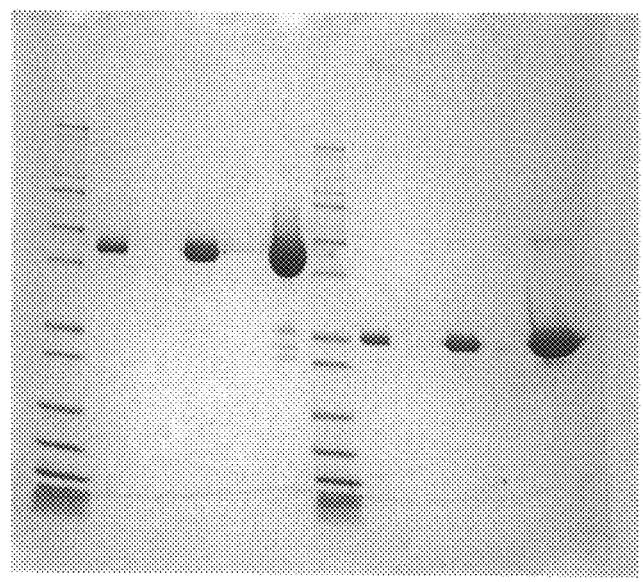

FIG. 49B shows Coomassie brilliant blue stained tris-glycine 4-20% SDS-PAGE of the final Fc-L10-OsK1 product. Lane 1-12 are loaded as follows: Novex Mark 12 wide range protein standards, 0.5 μg product non-reduced, blank, 2.0 μg product non-reduced, blank, 10 μg product non-reduced, Novex Mark 12 wide range protein standards, 0.5 μg product reduced, blank, 2.0 μg product reduced, blank, and 10 μg product reduced.

Figure 49C:
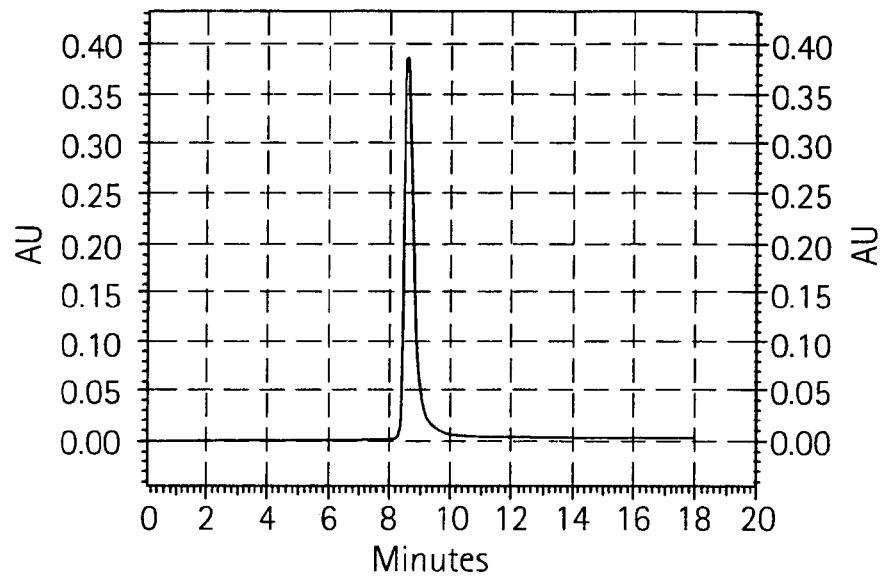
Figure 55A:
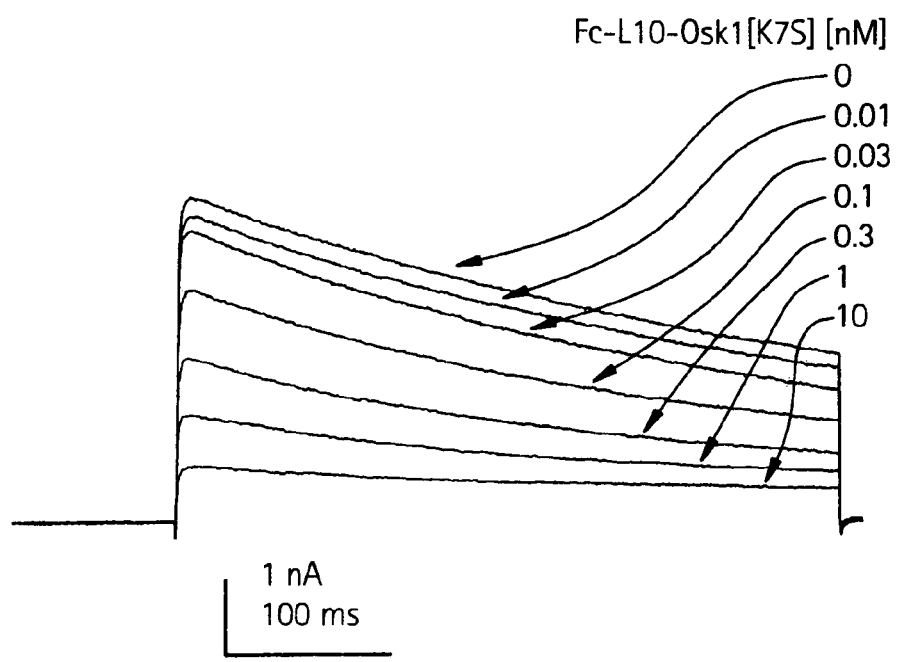
Figure 55B:
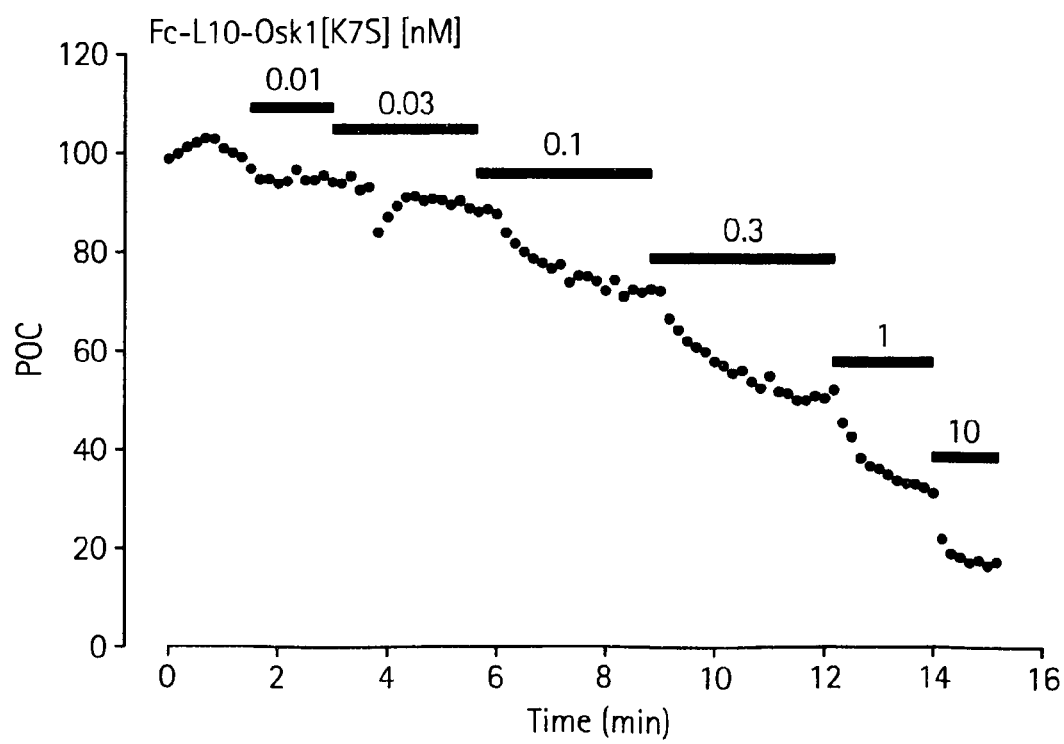

FIG. 49C shows Size exclusion chromatography on 149 μg of the final Fc-L10-OsK1 product injected on to a Phenomenex BioSep SEC 3000 column (7.8×300 mm) in 50 mM $NaH_2PO_4$, 250 mM NaCl, pH 6.9 at 1 ml/min observing the absorbance at 280 nm.

FIG. 49D shows MALDI mass spectral analysis of the final sample of Fc-L10-OsK1 analyzed using a Voyager DE-RP time-of-flight mass spectrometer equipped with a nitrogen laser (337 nm, 3 ns pulse). The positive ion/linear mode was used, with an accelerating voltage of 25 kV. Each spectrum was produced by accumulating data from ~200 laser shots. External mass calibration was accomplished using purified proteins of known molecular masses.

FIG. 50A shows a spectral scan of 50 μl of the Fc-L10-OsK1(K7S) product diluted in 700 μl PBS (blanking buffer) using a Hewlett Packard 8453 spectrophotometer and a 1 cm path length quartz cuvette.

FIG. 50B shows Coomassie brilliant blue stained tris-glycine 4-20% SDS-PAGE of the final Fc-L10-OsK1(K7S) product. Lane 1-12 are loaded as follows: Novex Mark 12 wide range protein standards, 0.5 μg product non-reduced, blank, 2.0 μg product non-reduced, blank, 10 μg product non-reduced, Novex Mark 12 wide range protein standards, 0.5 μg product reduced, blank, 2.0 μg product reduced, blank, and 10 μg product reduced.

FIG. 50C shows size exclusion chromatography on 50 μg of the final Fc-L10-OsK1(K7S) product injected on to a Phenomenex BioSep SEC 3000 column (7.8×300 mm) in 50 mM $NaH_2PO_4$, 250 mM NaCl, pH 6.9 at 1 ml/min observing the absorbance at 280 nm.

FIG. 50D shows MALDI mass spectral analysis of a sample of the final product Fc-L10-OsK1(K7S) analyzed using a Voyager DE-RP time-of-flight mass spectrometer equipped with a nitrogen laser (337 nm, 3 ns pulse). The positive ion/linear mode was used, with an accelerating voltage of 25 kV. Each spectrum was produced by accumulating data from ~200 laser shots. External mass calibration was accomplished using purified proteins of known molecular masses.

FIG. 51A shows a spectral scan of 50 μl of the Fc-L10-OsK1(E16K, K20D) product diluted in 700 μl PBS (blanking buffer) using a Hewlett Packard 8453 spectrophotometer and a 1 cm path length quartz cuvette.

FIG. 51B shows Coomassie brilliant blue stained tris-glycine 4-20% SDS-PAGE of the final Fc-L10-OsK1(E16K, K20D) product. Lane 1-12 are loaded as follows: Novex Mark 12 wide range protein standards, 0.5 μg product non-reduced, blank, 2.0 μg product non-reduced, blank, 10 μg product non-reduced, Novex Mark 12 wide range protein standards, 0.5 μg product reduced, blank, 2.0 μg product reduced, blank, and 10 μg product reduced.

FIG. 51C shows size exclusion chromatography on 50 μg of the final Fc-L10-OsK1(E16K, K20D) product injected on to a Phenomenex BioSep SEC 3000 column (7.8×300 mm) in 50 mM $NaH_2PO_4$, 250 mM NaCl, pH 6.9 at 1 ml/min observing the absorbance at 280 nm.

FIG. 51D shows MALDI mass spectral analysis of a sample of the final product Fc-L10-OsK1(E16K, K20D) analyzed using a Voyager DE-RP time-of-flight mass spectrometer equipped with a nitrogen laser (337 nm, 3 ns pulse). The positive ion/linear mode was used, with an accelerating voltage of 25 kV. Each spectrum was produced by accumulating data from ~200 laser shots. External mass calibration was accomplished using purified proteins of known molecular masses.

FIG. 52A shows a spectral scan of 50 μl of the Fc-L10-OsK1(K7S, E16K, K20D) product diluted in 700 μl PBS (blanking buffer) using a Hewlett Packard 8453 spectrophotometer and a 1 cm path length quartz cuvette.

FIG. 52B shows Coomassie brilliant blue stained tris-glycine 4-20% SDS-PAGE of the final Fc-L10-OsK1(K7S, E16K, K20D) product. Lanes 1-12 are loaded as follows: Novex Mark 12 wide range protein standards, 0.5 μg product non-reduced, blank, 2.0 μg product non-reduced, blank, 10 μg product non-reduced, Novex Mark 12 wide range protein standards, 0.5 μg product reduced, blank, 2.0 μg product reduced, blank, and 10 μg product reduced.

FIG. 52C shows size exclusion chromatography on 50 μg of the final Fc-L10-OsK1(K7S, E16K, K20D) product injected on to a Phenomenex BioSep SEC 3000 column (7.8×300 mm) in 50 mM $NaH_2PO_4$, 250 mM NaCl, pH 6.9 at 1 ml/min observing the absorbance at 280 nm.

FIG. 52D shows MALDI mass spectral analysis of a sample of the final product Fc-L10-OsK1(K7S, E16K, K20D) analyzed using a Voyager DE-RP time-of-flight mass spectrometer equipped with a nitrogen laser (337 nm, 3 ns pulse). The positive ion/linear mode was used, with an accelerating voltage of 25 kV. Each spectrum was produced by accumulating data from ~200 laser shots. External mass calibration was accomplished using purified proteins of known molecular masses.

FIG. 53 shows inhibition of the outward potassium current recorded from HEK293 cell stably expressing human Kv1.3 channel by synthetic Osk1, a 38-residue toxin peptide of the Asian scorpion *Orthochirus scrobiculosus* venom. FIG. 53A shows a concentration dependent block of the outward potassium current recorded from HEK293 cell stably expressing human Kv1.3 channel by the synthetic Osk1 toxin peptide. FIG. 53B shows the time course of the synthetic Osk1 toxin peptide block at various concentrations. The IC50 for the synthetic Osk1 toxin peptide was estimated to be 39±12 pM (n=4 cells).

FIG. 54 shows that modification of the synthetic OSK1 toxin peptide by fusion to the Fc-fragment of an antibody (OSK1-peptibody) retained the inhibitory activity against the human Kv1.3 channel. FIG. 54A shows a concentration dependent block of the outward potassium current recorded from HEK293 cells stably expressing human Kv1.3 channel by OSK1 linked to a human IgG1 Fc-fragment with a linker chain length of 10 amino acid residues (Fc-L10-OSK1). The fusion construct was stably expressed in Chinese Hamster Ovarian (CHO) cells. FIG. 54B shows the time course of the Fc-L10-OSK1 block at various concentrations. The IC50 for Fc-L10-OSK1 was estimated to be 198±35 pM (n=6 cells), approximately 5-fold less potent than the synthetic OSK1 toxin peptide.

FIG. 55 shows that a single amino-acid residue substitution of the OSK1-peptibody retained the inhibitory activity against the human Kv1.3 channel. FIG. 55A shows a concentration dependent block of the outward potassium current recorded from HEK293 cell stably expressing human Kv1.3 channel by OSK1-peptibody with a single amino acid substitution (lysine to serine at the $7^{th}$ position from N-terminal, [K7S]) and linked to a human IgG1 Fc-fragment with a linker chain length of 10 amino acid residues (Fc-L10-OSK1 [K7S]). The fusion construct was stably expressed in Chinese Hamster Ovarian (CHO) cells. FIG. 55B shows the time course of potassium current block by Fc-L10-OSK1[K7S] at various concentrations. The IC50 was estimated to be 372±71 pM (n=4 cells), approximately 10-fold less potent than the synthetic OSK1 toxin peptide.

Figure 56A:
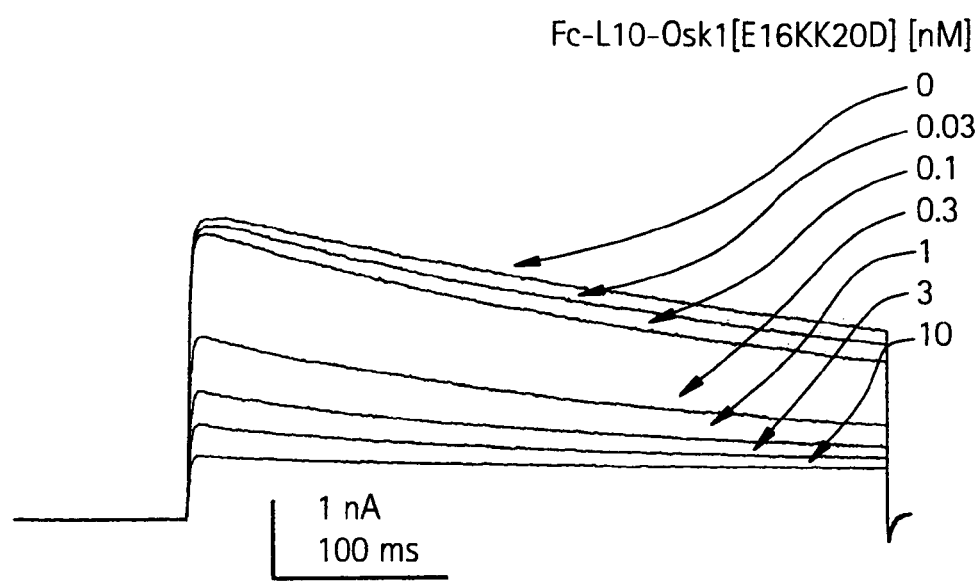
Figure 56B:
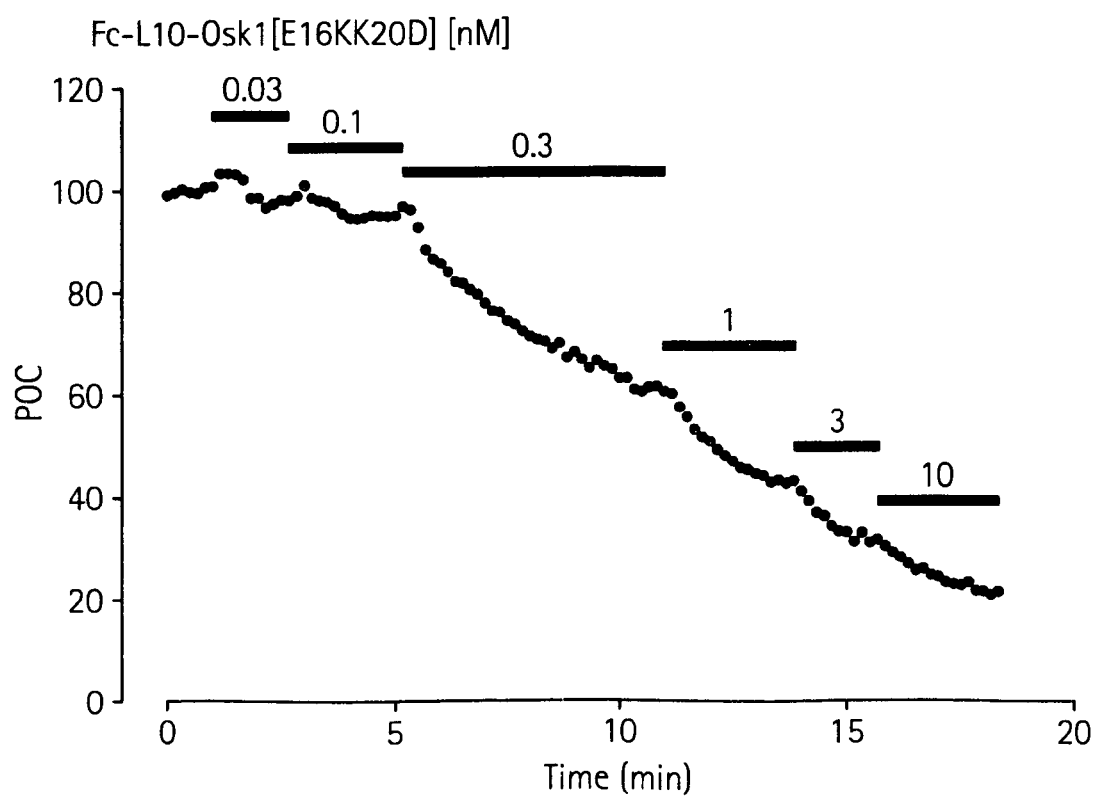

FIG. 56 shows that a two amino-acid residue substitution of the OSK1-peptibody retained the inhibitory activity against the human Kv1.3 channel. FIG. 56A shows a concentration dependent block of the outward potassium current recorded from HEK293 cell stably expressing human Kv1.3 channel by OSK1-peptibody with two amino acid substitutions (glutamic acid to lysine and lysine to aspartic acid at the $16^{th}$ and $20^{th}$ position from N-terminal respectively, [E16KK20D]) and linked to a human IgG1 Fc-fragment with a linker chain length of 10 amino acid residues (Fc-L10-OSK1[E16KK20D]). The fusion construct was stably expressed in Chinese Hamster Ovarian (CHO) cells. FIG. 56B shows the time course of potassium current block by Fc-L10-OSK1[E16KK20D] at various concentrations. The IC50 was estimated to be 248±63 pM (n=3 cells), approximately 6-fold less potent than the synthetic OSK1 toxin peptide.

Figure 57A:
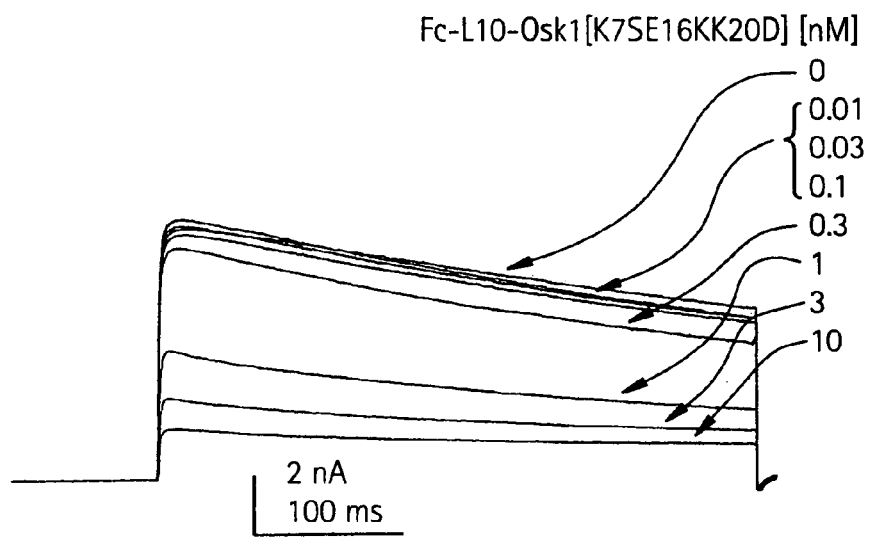
Figure 57B:
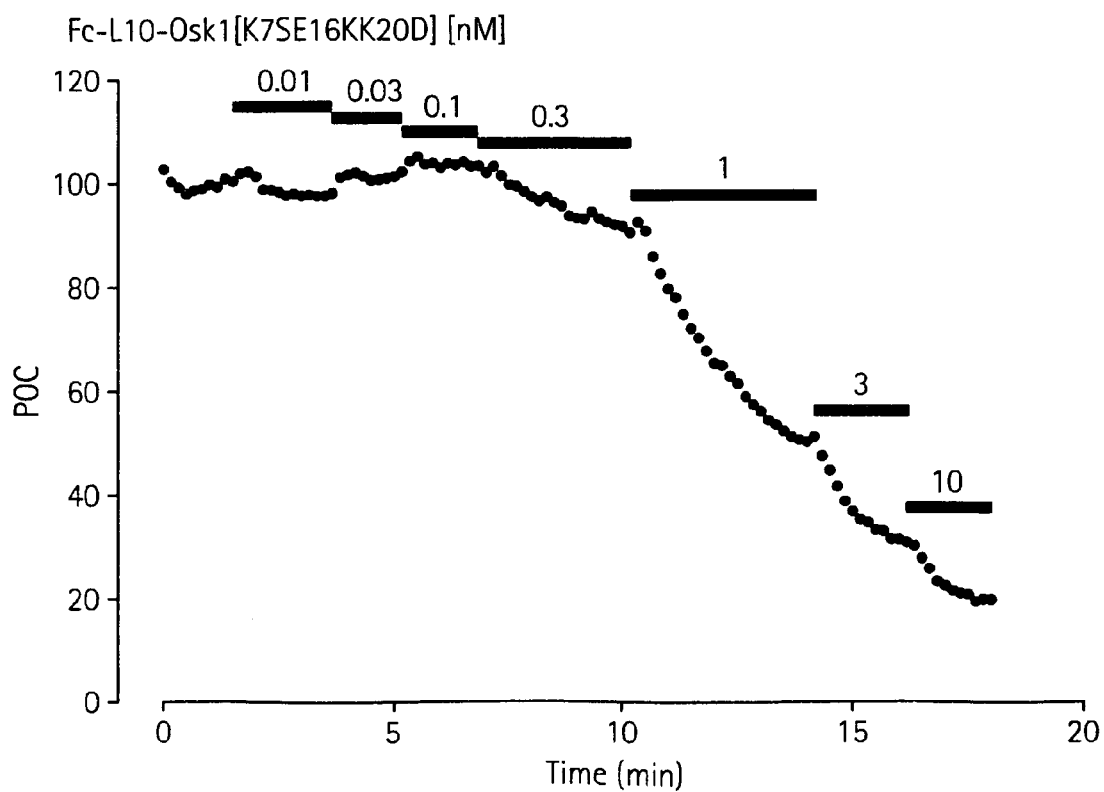

FIG. 57 shows that a triple amino-acid residue substitution of the OSK1-peptibody retained the inhibitory activity against the human Kv1.3 channel, but the potency of inhibition was significantly reduced when compared to the synthetic OSK1 toxin peptide. FIG. 57A shows a concentration dependent block of the outward potassium current recorded from HEK293 cell stably expressing human Kv1.3 channel by OSK1-peptibody with triple amino acid substitutions (lysine to serine, glutamic acid to lysine and lysine to aspartic acid at the $7^{th}$, $16^{th}$ and $20^{th}$ position from N-terminal respectively, [K7SE16KK20D]) and linked to a human IgG1 Fc-fragment with a linker chain length of 10 amino acid residues (Fc-L10-OSK1[K7SE16KK20D]). The fusion construct was stably expressed in Chinese Hamster Ovarian (CHO) cells. FIG. 57B shows the time course of potassium current block by Fc-L10-OSK1[K7SE16KK20D] at various concentrations. The IC50 was estimated to be 812±84 pM (n=3 cells), approximately 21-fold less potent than the synthetic OSK1 toxin peptide.

Figure 58A:
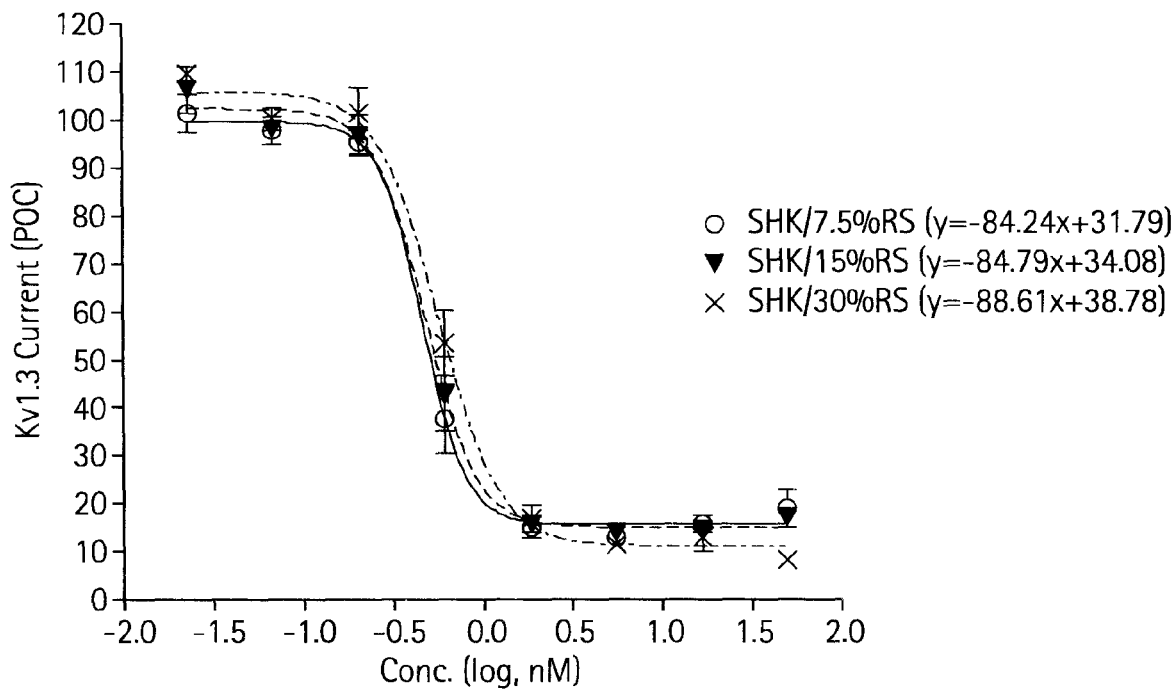
Figure 58B:
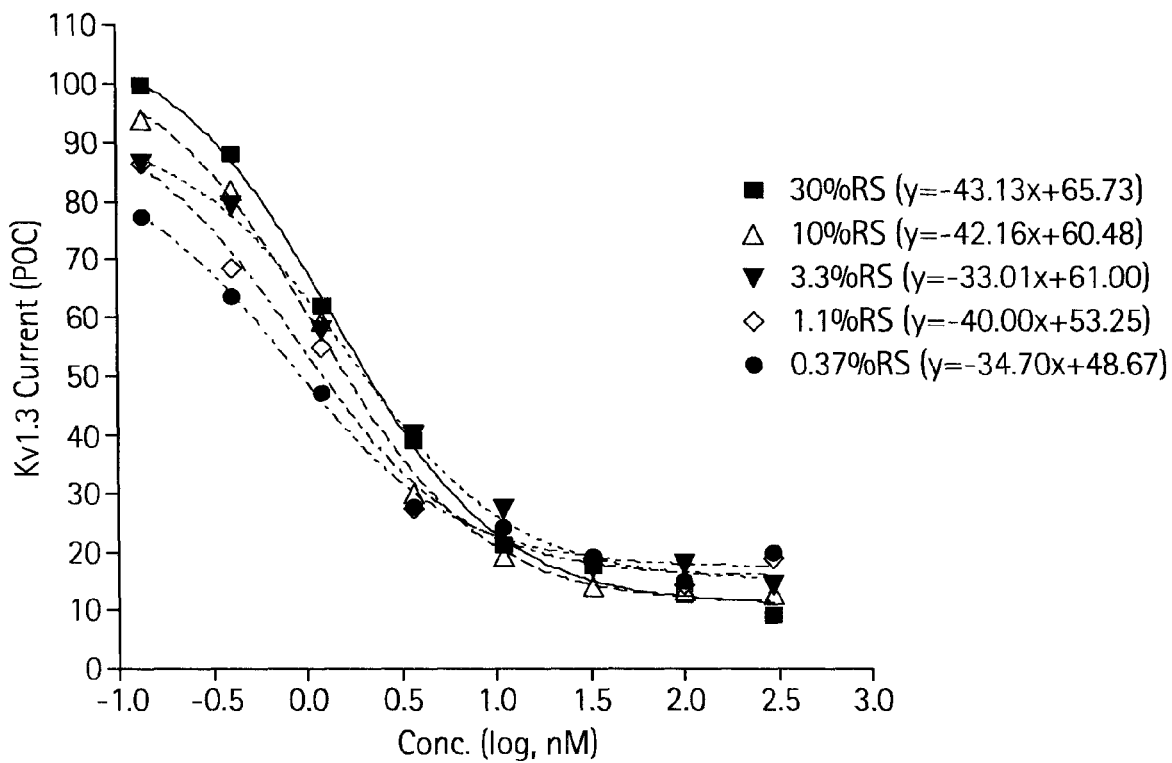

FIG. 58 shows Standard curves for ShK (FIG. 58A) and 20K PEG-ShK[1-35] (FIG. 58B) containing linear regression equations for each Standard at a given percentage of serum.

Figure 59:
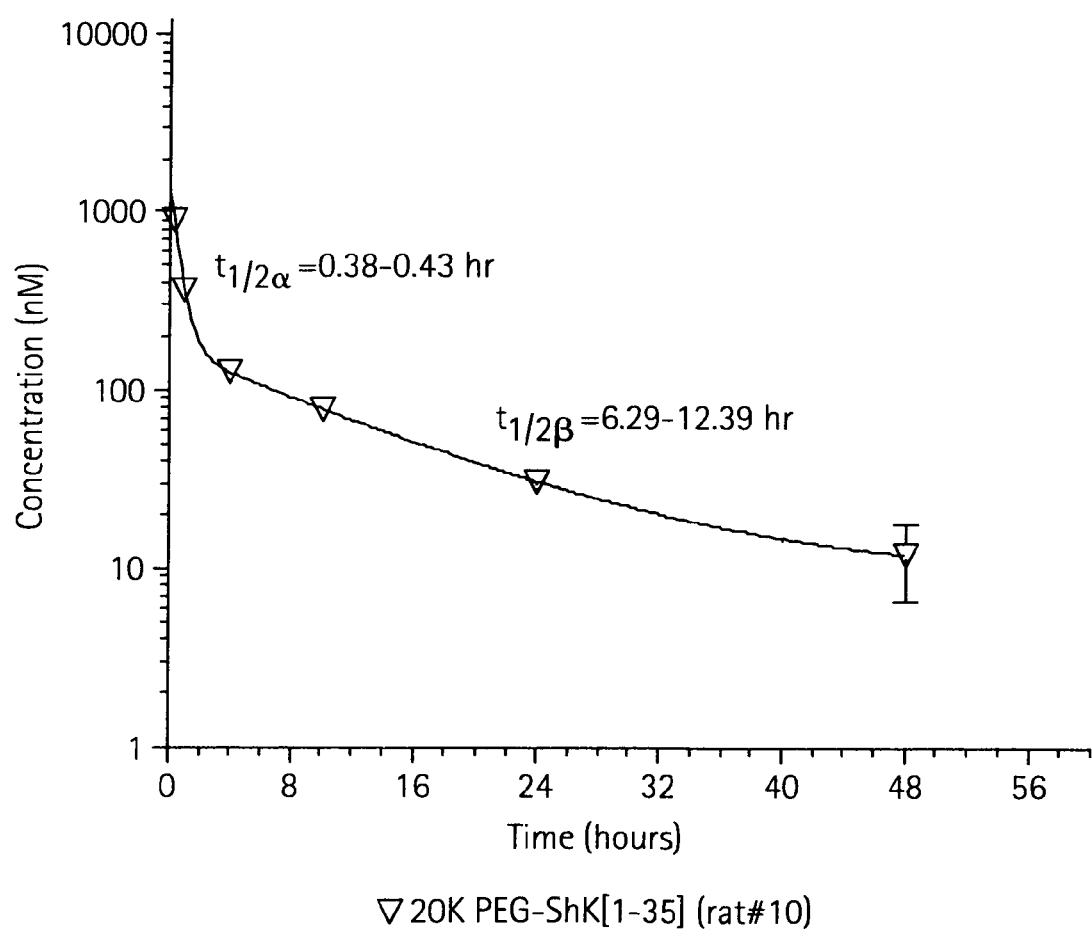

FIG. 59 shows the pharmacokinetic profile in rats of 20K PEG ShK[1-35] molecule after IV injection.

Figure 60:
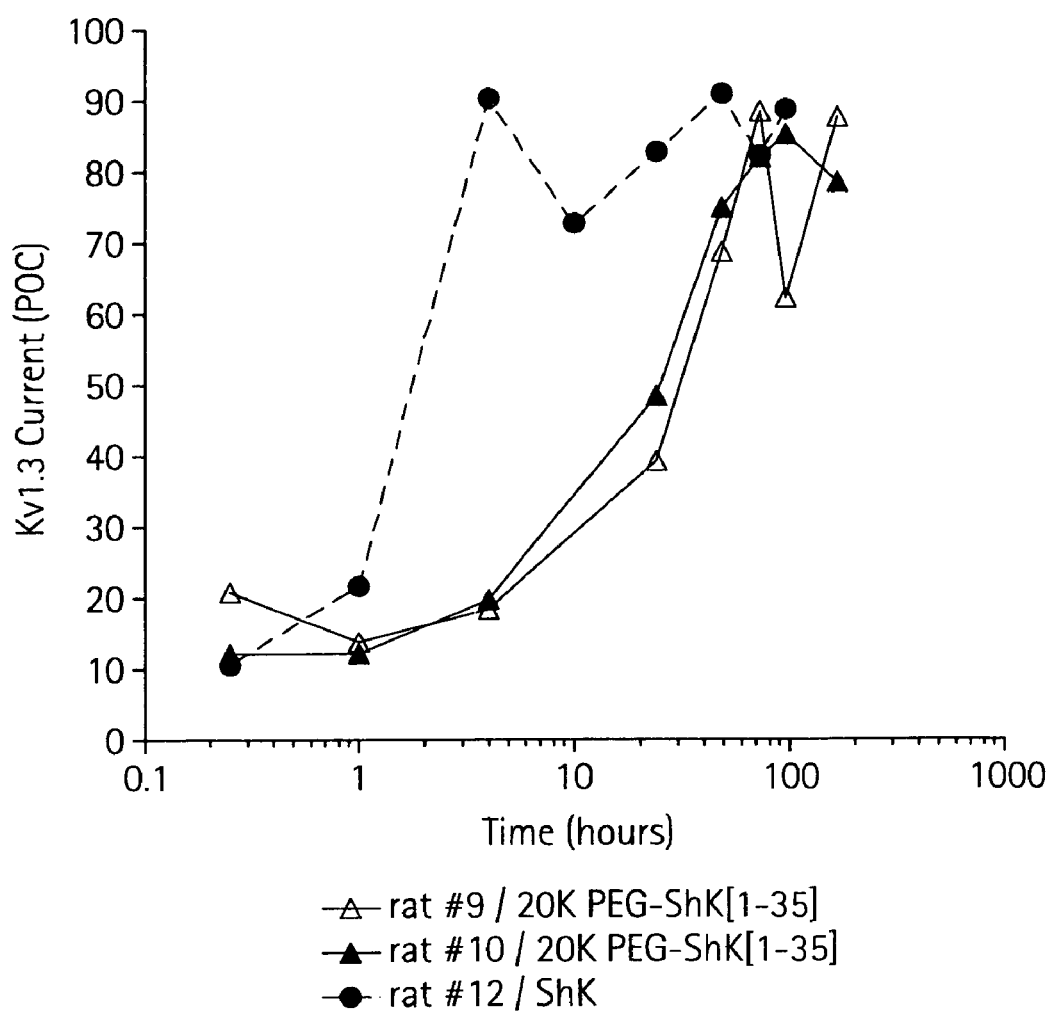

FIG. 60 shows Kv1.3 inhibitory activity in serum samples (5%) of rats receiving a single equal molar IV injection of Kv1.3 inhibitors ShK versus 20K PEG-ShK[1-35].

Figure 61:
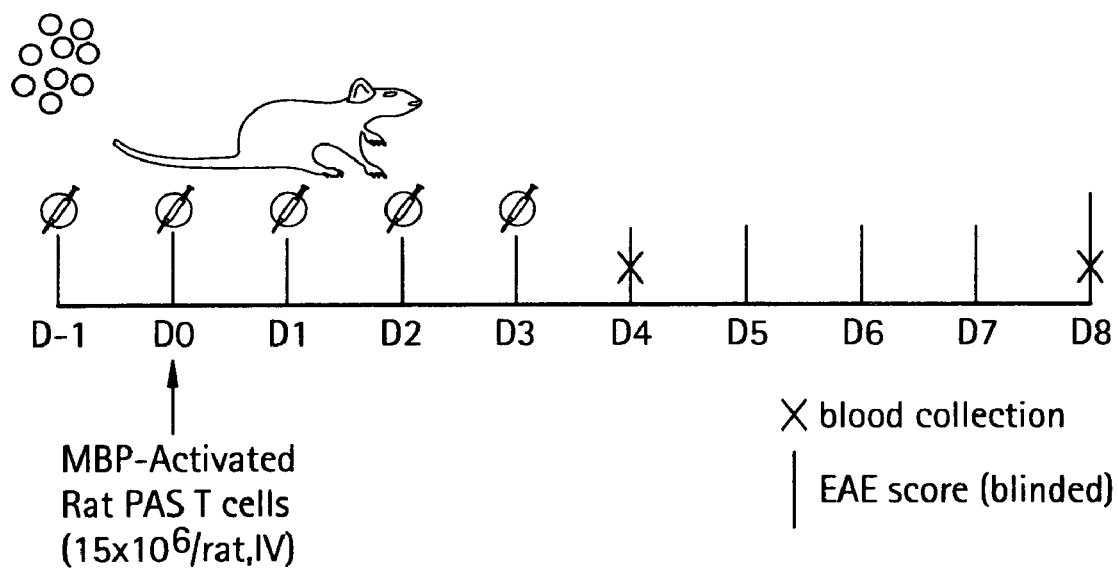

FIG. 61 illustrates an Adoptive Transfer EAE model experimental design (n=5 rats per treatment group). Dosing values in microgram per kilogram (mg/kg) are based on peptide content.

Figure 62:
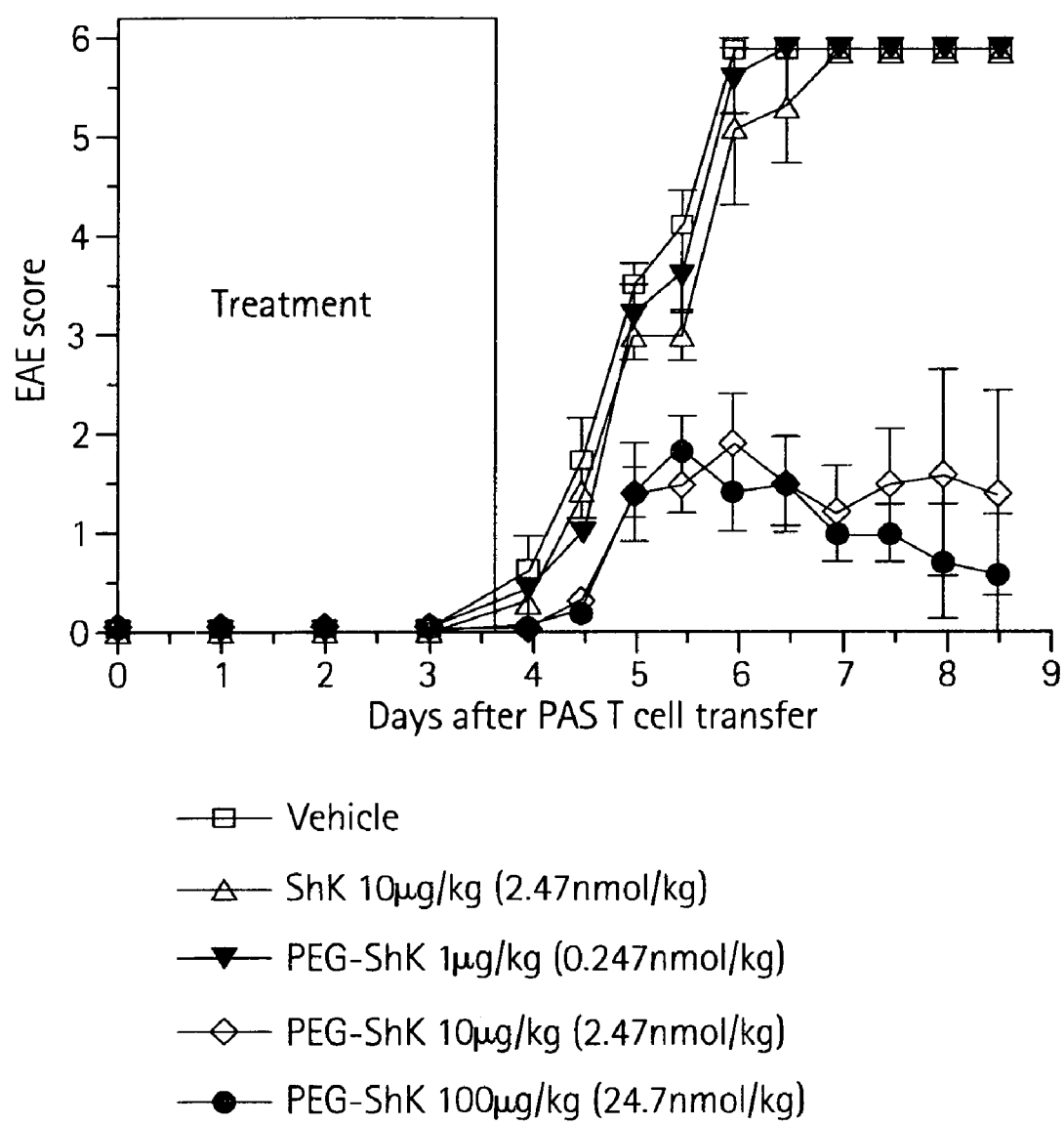

FIG. 62 shows that treatment with PEG-ShK ameliorated disease in rats in the adoptive transfer EAE model. Clinical scoring: 0=No signs, 0.5=distal limp tail, 1.0=limp tail, 2.0=mild paraparesis, ataxia, 3.0=moderate paraparesis, 3.5=one hind leg paralysis, 4.0=complete hind leg paralysis, 5.0=complete hind leg paralysis and incontinence, 5.5=tetraplegia, 6.0=moribund state or death. Rats reaching a score of 5.5 to 6 died or were euthanized. Mean±sem values are shown. (n=5 rats per treatment group.)

FIG. 63 shows that treatment with PEG-ShK prevented loss of body weight in the adoptive transfer EAE model. Rats were weighed on days—1, 4, 6, and 8 (for surviving rats). Mean±sem values are shown.

Figure 64A:
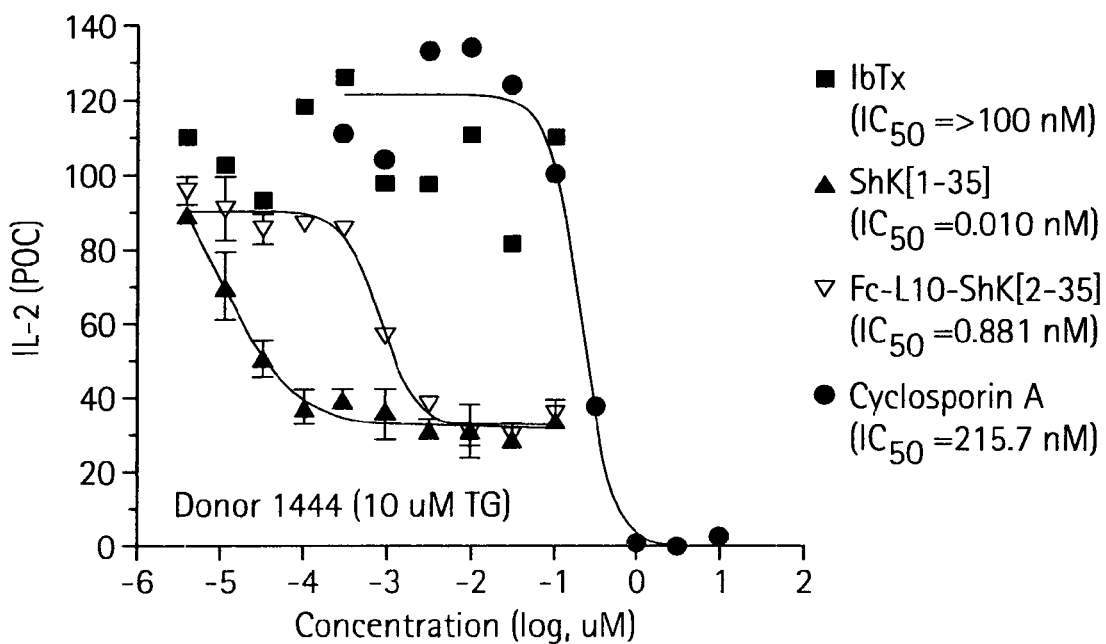
Figure 64B:
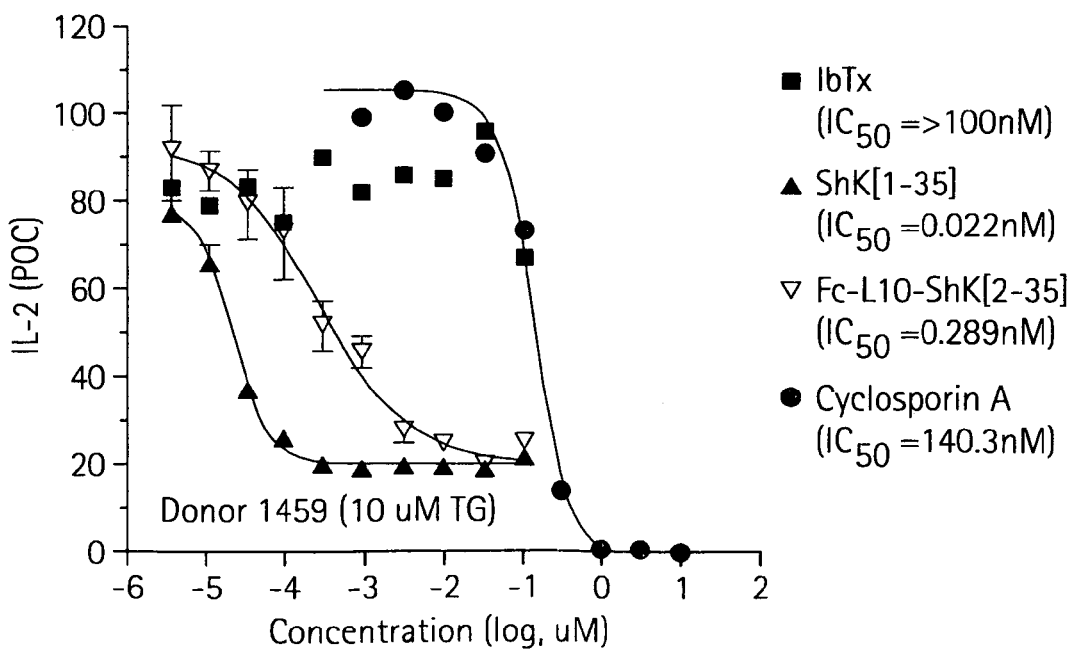

FIG. 64 shows that thapsigargin-induced IL-2 production in human whole blood was suppressed by the Kv1.3 channel inhibitors ShK[1-35] and Fc-L10-ShK[2-35]. The calcineurin inhibitor cyclosporine A also blocked the response. The BKCa channel inhibitor iberiotoxin (IbTx) showed no significant activity. The response of whole blood from two separate donors is shown in FIG. 64A and FIG. 64B.

Figure 65A:
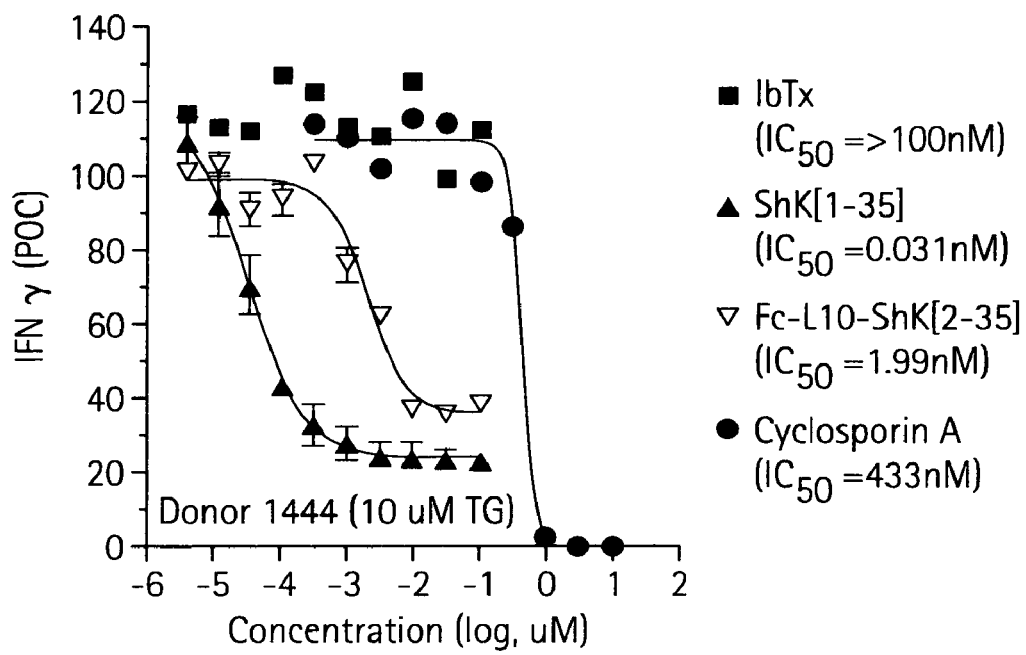
Figure 65B:
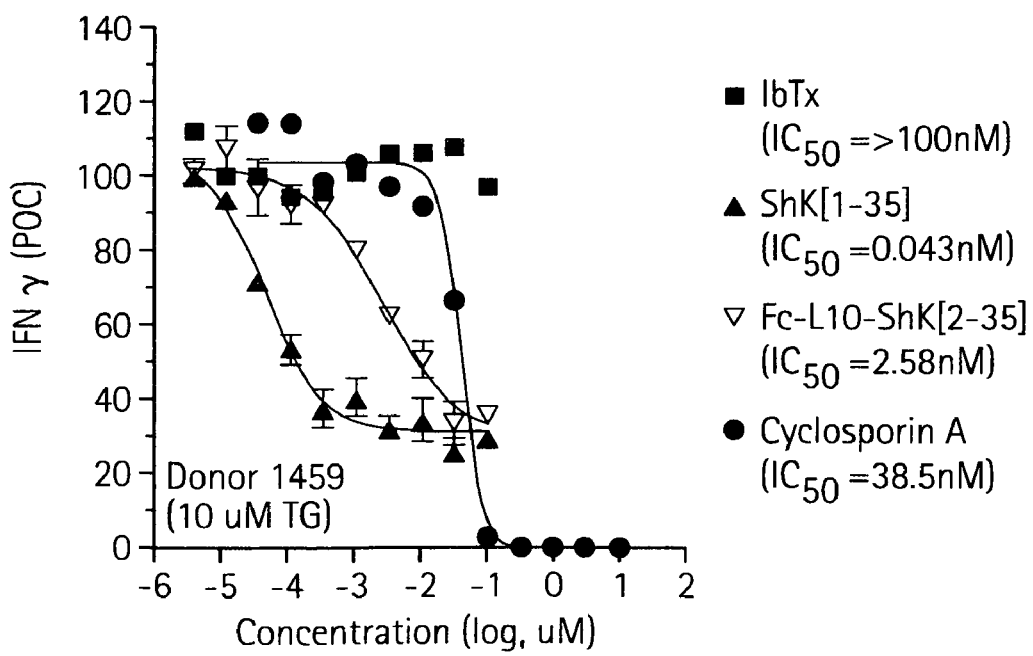

FIG. 65 shows that thapsigargin-induced IFN-g production in human whole blood was suppressed by the Kv1.3 channel inhibitors ShK[1-35] and Fc-L10-ShK[2-35]. The calcineurin inhibitor cyclosporine A also blocked the response. The BKCa channel inhibitor iberiotoxin (IbTx) showed no significant activity. The response of whole blood from two separate donors is shown in FIG. 65A and FIG. 65B.

Figure 66A:
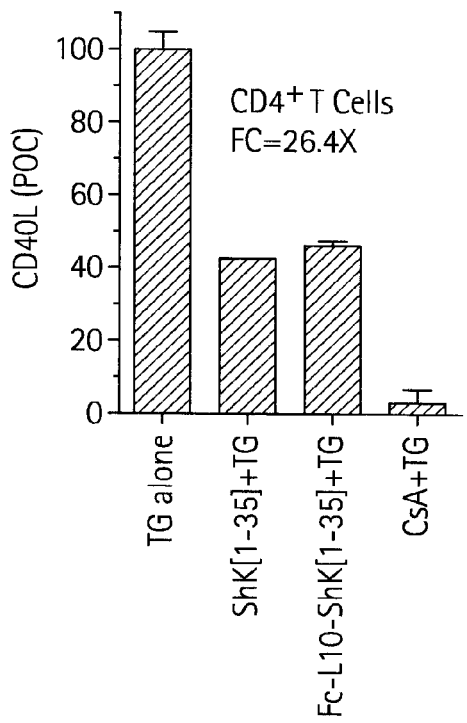
Figure 66B:
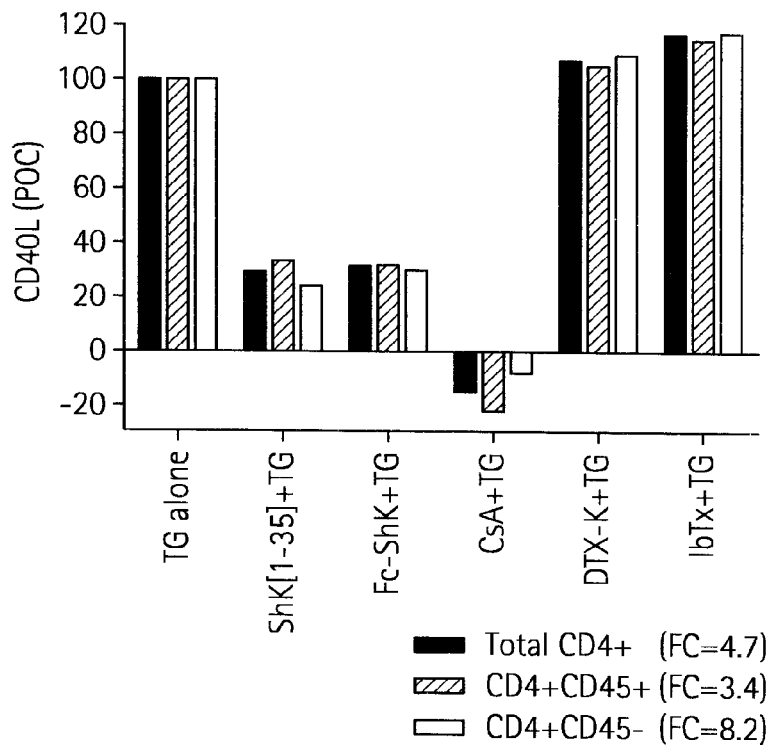

FIG. 66 shows that thapsigargin-induced upregulation of CD40L on T cells in human whole blood was suppressed by the Kv1.3 channel inhibitors ShK[1-35] and Fc-L10-ShK[1-35] (Fc-ShK). The calcineurin inhibitor cyclosporine A (CsA) also blocked the response. FIG. 66A shows results of an experiment looking at the response of total CD4+ T cells. FIG. 66B shows results of an experiment that looked at total CD4+ T cells, as well as CD4+CD45+ and CD4+CD45− T cells. In FIG. 66B, the BKCa channel inhibitor iberiotoxin (IbTx) and the Kv1.1 channel inhibitor dendrotoxin-K (DTX-K) showed no significant activity.

Figure 67A:
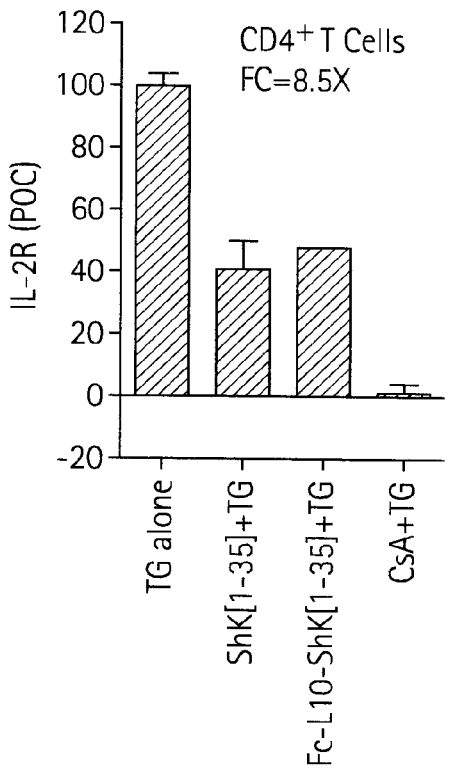
Figure 67B:
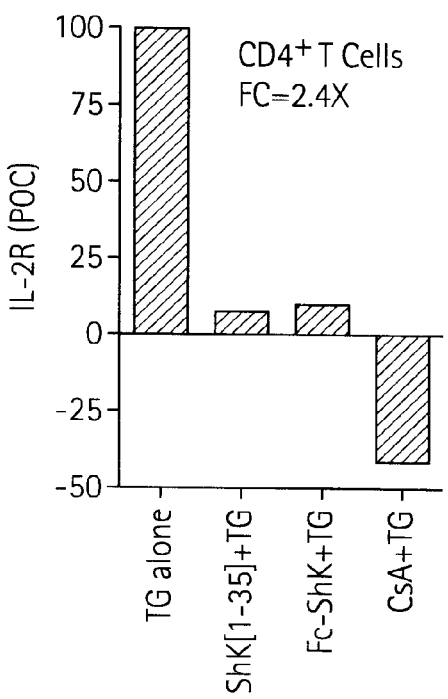

FIG. 67 shows that thapsigargin-induced upregulation of the IL-2R on T cells in human whole blood was suppressed by the Kv1.3 channel inhibitors ShK[1-35] and Fc-L10-ShK[1-35] (Fc-ShK). The calcineurin inhibitor cyclosporine A (CsA) also blocked the response. FIG. 67A shows results of an experiment looking at the response of total CD4+ T cells. FIG. 67B shows results of an experiment that looked at total CD4+ T cells, as well as CD4+CD45+ and CD4+CD45− T cells. In FIG. 67B, the BKCa channel inhibitor iberiotoxin (IbTx) and the Kv1.1 channel inhibitor dendrotoxin-K (DTX-K) showed no significant activity.

Figure 68A:
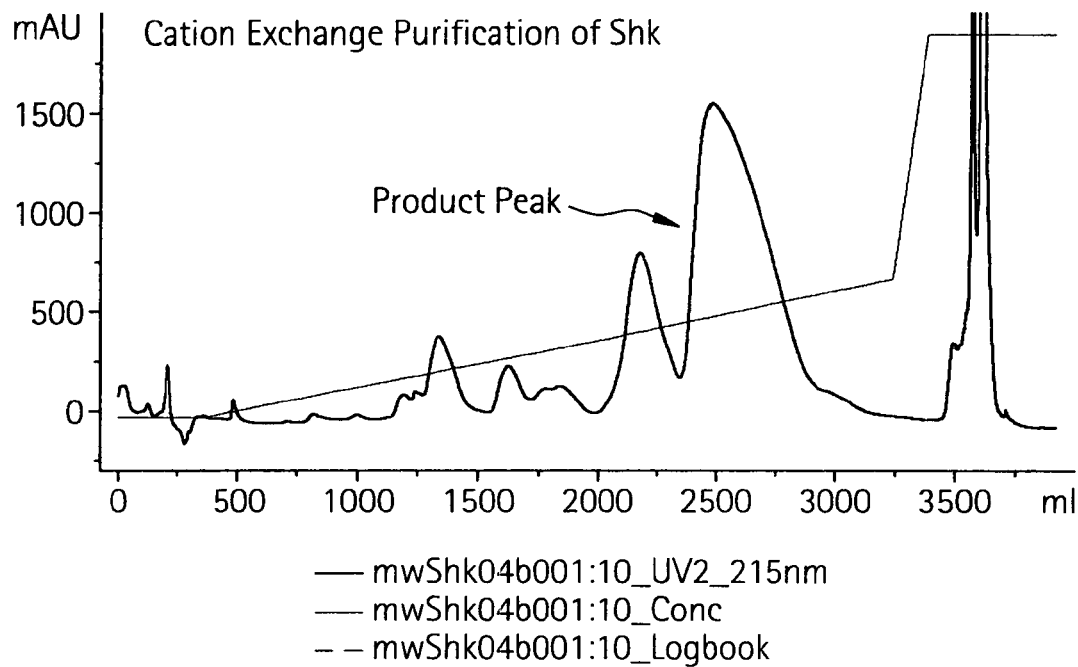
Figure 68B:
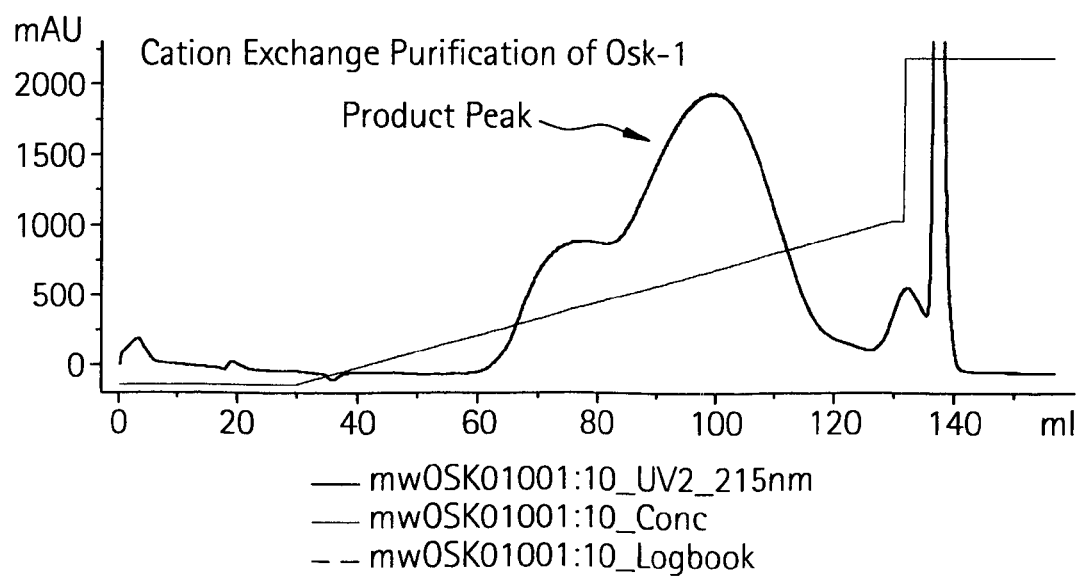

FIG. 68 shows cation exchange chromatograms of PEG-peptide purification on SP Sepharose HP columns for PEG-Shk purification (FIG. 68A) and PEG-OSK-1 purification (FIG. 68B).

Figure 69A:
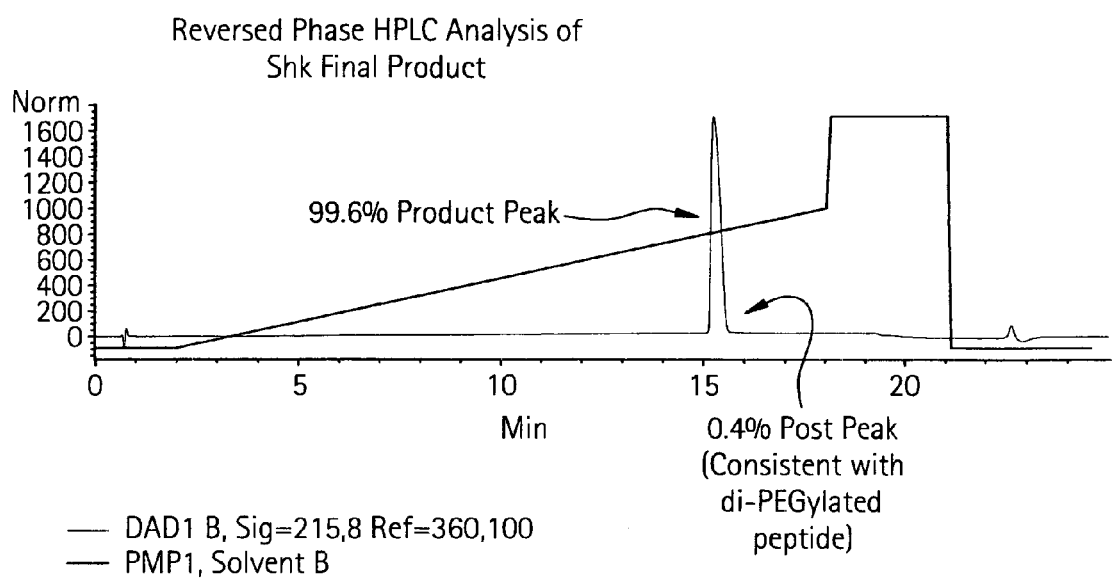
Figure 69B:
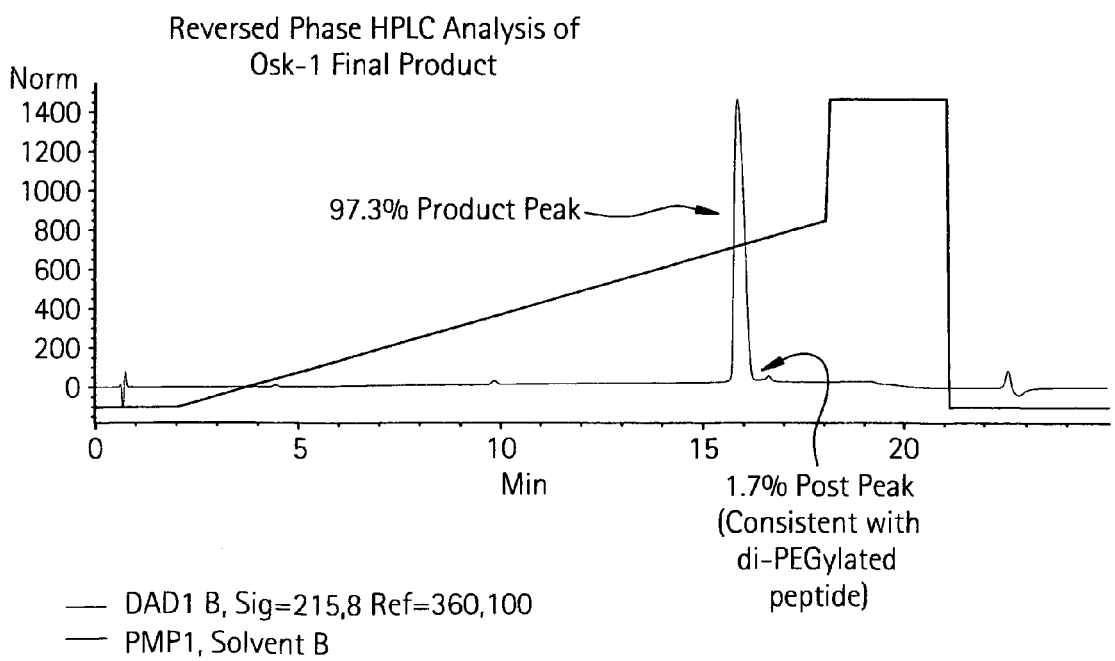

FIG. 69 shows RP-HPLC chromatograms on final PEG-peptide pools to demonstrate purity of PEG-Shk purity>99% (FIG. 69A) and PEG-Osk1 purity>97% (FIG. 69B).

FIG. 70 shows the amino acid sequence (SEQ ID NO: 976) of an exemplary FcLoop-L2-OsK1-L2 having three linked domains: Fc N-terminal domain (amino acid residues 1-139); OsK1 (underlined amino acid residues 142-179); and Fc C-terminal domain (amino acid residues 182-270).

FIG. 71 shows the amino acid sequence (SEQ ID NO: 977) of an exemplary FcLoop-L2-ShK-L2 having three linked domains: Fc N-terminal domain (amino acid residues 1-139); ShK (underlined amino acid residues 142-176); and Fc C-terminal domain (amino acid residues 179-267).

FIG. 72 shows the amino acid sequence (SEQ ID NO: 978) of an exemplary FcLoop-L2-ShK-L4 having three linked domains: Fc N-terminal domain (amino acid residues 1-139); ShK (underlined amino acid residues 142-176); and Fc C-terminal domain (amino acid residues 181-269).

FIG. 73 shows the amino acid sequence (SEQ ID NO: 979) of an exemplary FcLoop-L4-OsK1-L2 having three linked domains: Fc N-terminal domain (amino acid residues 1-139); OsK1 (underlined amino acid residues 144-181); and Fc C-terminal domain (amino acid residues 184-272).

Figure 74:
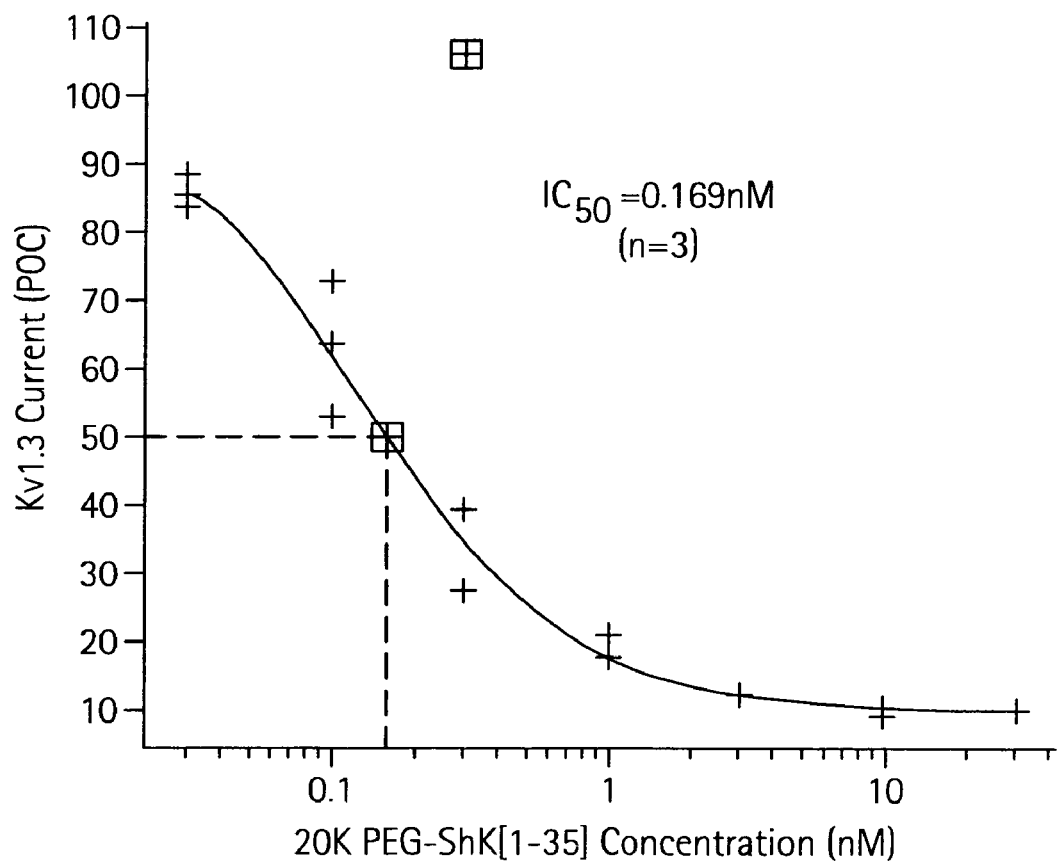

FIG. 74 shows that the 20K PEGylated ShK[1-35] provided potent blockade of human Kv1.3 as determined by whole cell patch clamp electrophysiology on HEK293/Kv1.3 cells. The data represents blockade of peak current.

FIG. 75 shows schematic structures of some other exemplary embodiments of the composition of matter of the invention. "$X^2$" and "$X^3$" represent toxin peptides or linker-toxin peptide combinations (i.e., -(L)$_f$-P-(L)$_g$-) as defined herein. As described herein but not shown in FIG. 75, an additional $X^1$ domain and one or more additional PEG moieties are also encompassed in other embodiments. The specific embodiments shown here are as follows:

FIG. 75C, FIG. 75D, FIG. 75G and FIG. 75H: show a single chain molecule and can also represent the DNA construct for the molecule.

FIG. 75A, FIG. 75B, FIG. 75E and FIG. 75F: show doubly disulfide-bonded Fc dimers (in position $F^2$); FIG. 75A and FIG. 75B show a dimer having the toxin peptide portion on both chains in position $X^3$; FIG. 75E and FIG. 75F show a dimer having the toxin peptide portion on both chains In position $X^2$.

Figure 76A:
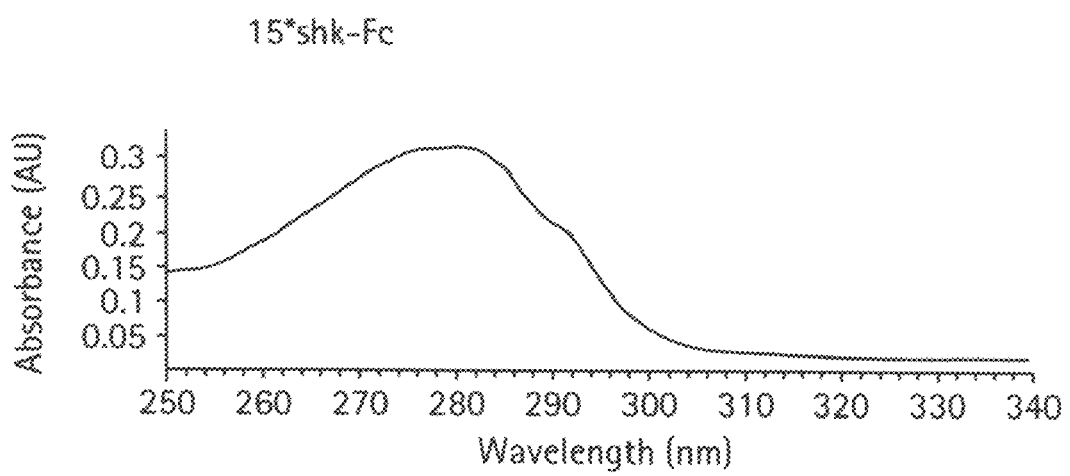

FIG. 76A shows a spectral scan of 50 μl of the ShK[2-35]-Fc product diluted in 700 μl PBS (blanking buffer) using a Hewlett Packard 8453 spectrophotometer and a 1 cm path length quartz cuvette.

Figure 76B:
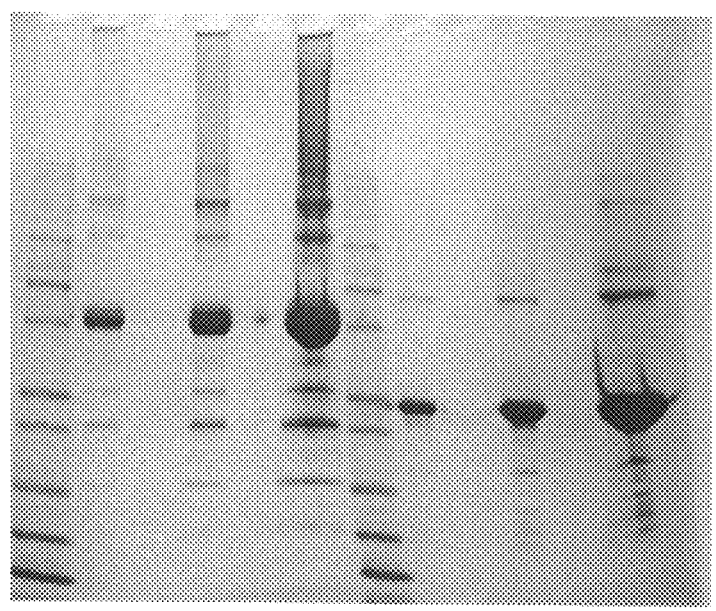

FIG. 76B shows Coomassie brilliant blue stained tris-glycine 4-20% SDS-PAGE of the final ShK[2-35]-Fc product. Lanes 1-12 were loaded as follows: Novex Mark 12 wide range protein standards, 0.5 μg product non-reduced, blank, 2.0 μg product non-reduced, blank, 10 μg product non-reduced, Novex Mark 12 wide range protein standards, 0.5 μg product reduced, blank, 2.0 μg product reduced, blank, and 10 μg product reduced.

Figure 76C:
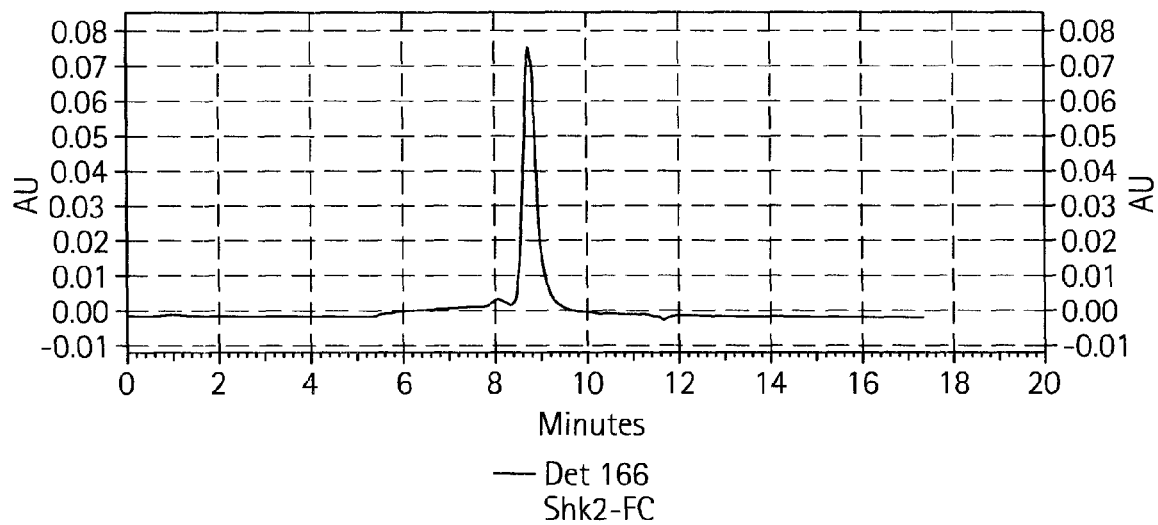

FIG. 76C shows size exclusion chromatography on 70 μg of the final ShK[2-35]-Fc product injected on to a Phenomenex BioSep SEC 3000 column (7.8×300 mm) in 50 mM NaH$_2$PO$_4$, 250 mM NaCl, pH 6.9 at 1 ml/min observing the absorbance at 280 nm.

Figure 76D:
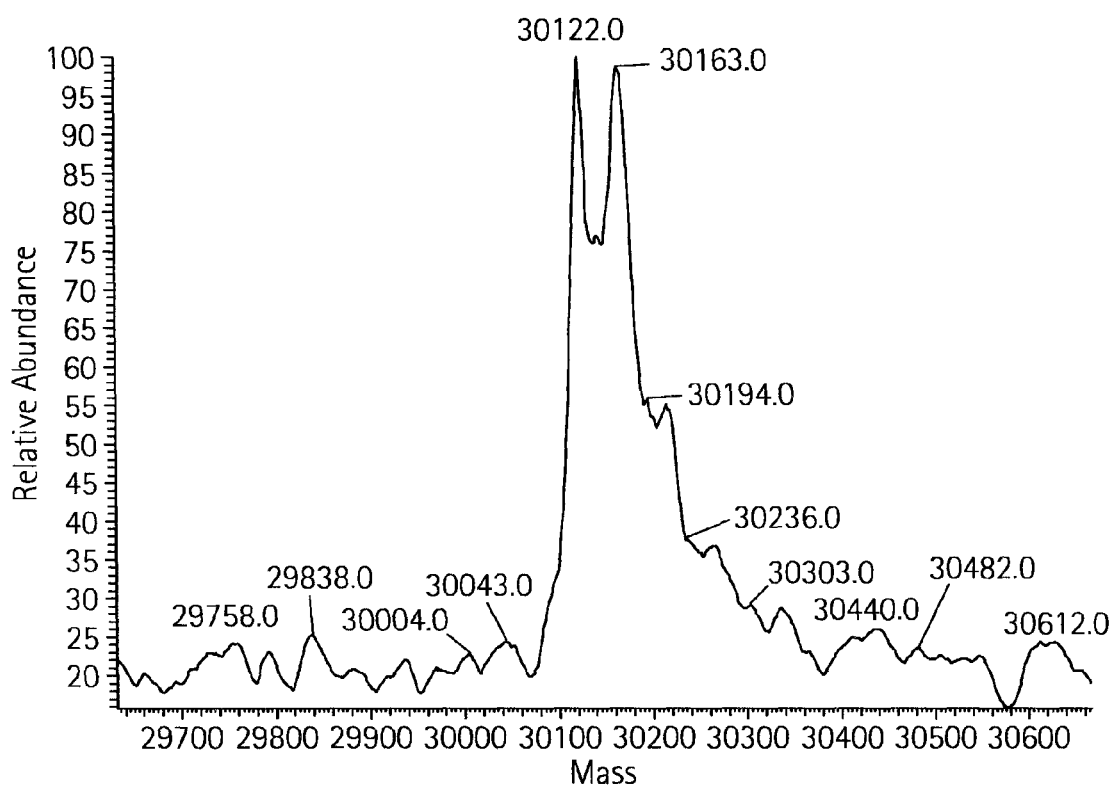

FIG. 76D shows LC-MS analysis of the final ShK[2-35]-Fc sample using an Agilent 1100 HPCL running reverse phase chromatography, with the column effluent directly coupled to an electrospray source of a Thermo Finnigan LCQ ion trap mass spectrometer. Relevant spectra were summed and deconvoluted to mass data with the Bioworks software package.

Figure 77A:
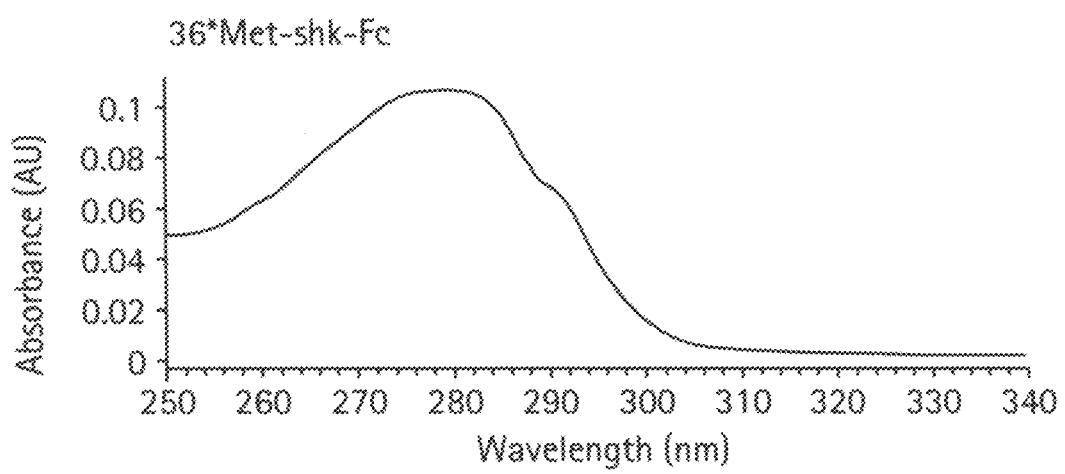

FIG. 77A shows a spectral scan of 20 μl of the met-ShK [1-35]-Fc product diluted in 700 μl PBS (blanking buffer) using a Hewlett Packard 8453 spectrophotometer and a 1 cm path length quartz cuvette.

Figure 77B:
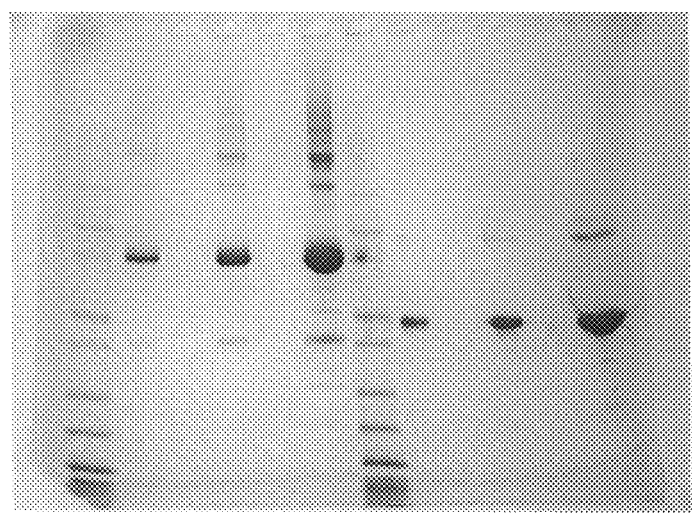

FIG. 77B shows Coomassie brilliant blue stained tris-glycine 4-20% SDS-PAGE of the final met-ShK[1-35]-Fc product. Lanes 1-12 were loaded as follows: Novex Mark 12 wide range protein standards, 0.5 μg product non-reduced, blank, 2.0 μg product non-reduced, blank, 10 μg product non-reduced, Novex Mark 12 wide range protein standards, 0.5 μg product reduced, blank, 2.0 μg product reduced, blank, and 10 μg product reduced.

Figure 77C:
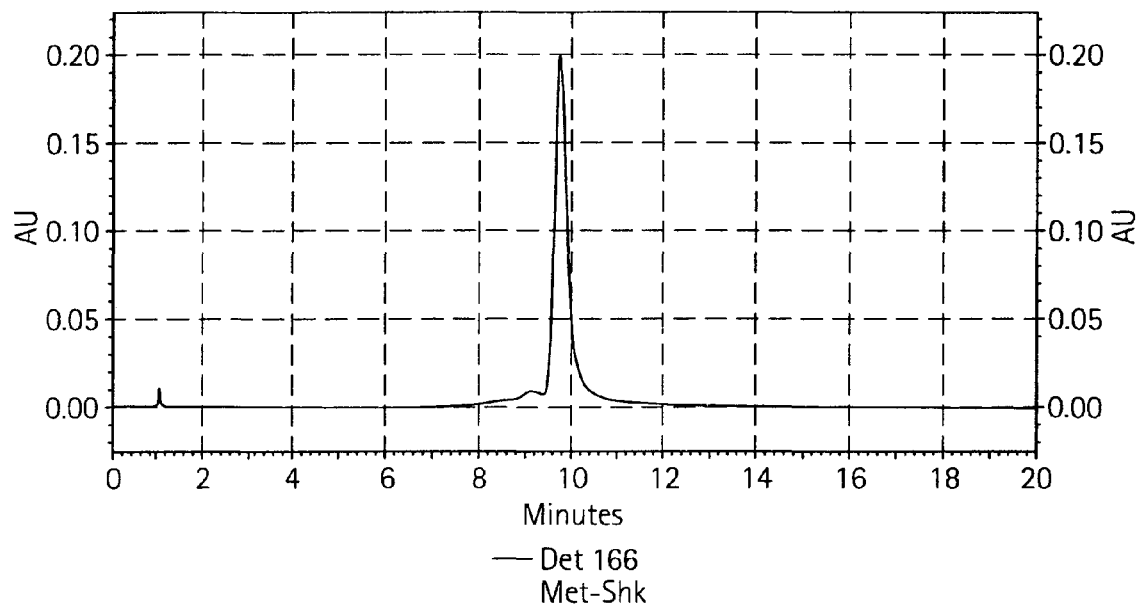

FIG. 77C shows size exclusion chromatography on 93 μg of the final met-ShK[1-35]-Fc product injected on to a Phenomenex BioSep SEC 3000 column (7.8×300 mm) in 50 mM NaH$_2$PO$_4$, 250 mM NaCl, pH 6.9 at 1 ml/min observing the absorbance at 280 nm.

Figure 77D:
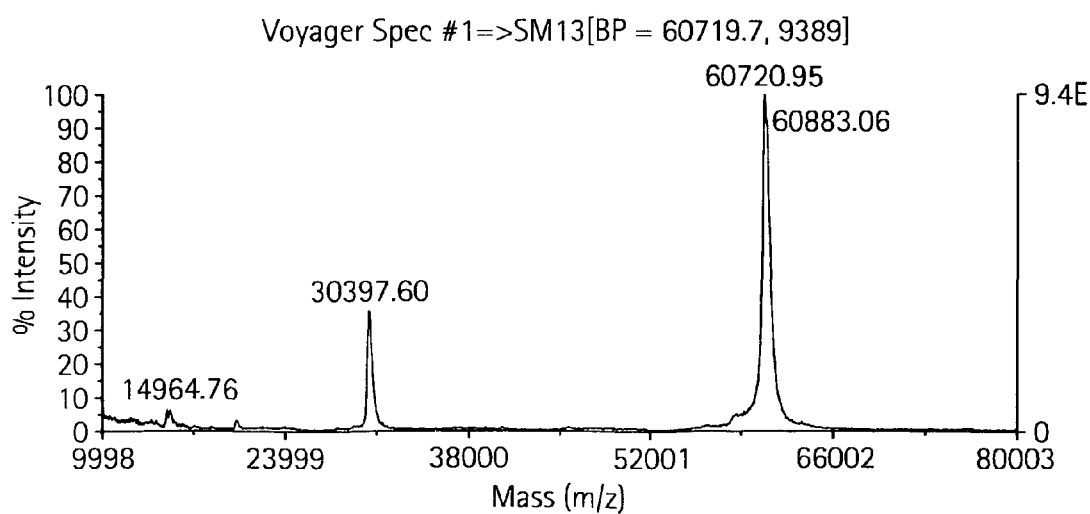

FIG. 77D shows MALDI mass spectral analysis of the final met-ShK[1-35]-Fc sample analyzed using a Voyager DE-RP time-of-flight mass spectrometer equipped with a nitrogen laser (337 nm, 3 ns pulse). The positive ion/linear mode was used, with an accelerating voltage of 25 kV. Each spectrum was produced by accumulating data from ~200 laser shots. External mass calibration was accomplished using purified proteins of known molecular masses.

DETAILED DESCRIPTION OF EMBODIMENTS OF THE INVENTION

Definition of Terms

The terms used throughout this specification are defined as follows, unless otherwise limited in specific instances. As used in the specification and the appended claims, the singular forms "a", "an", and "the" include plural referents unless the context clearly dictates otherwise.

The term "half-life extending moiety" (i.e., $F^1$ or $F^2$ in Formula I) refers to a pharmaceutically acceptable moiety, domain, or "vehicle" covalently linked or conjugated to the toxin peptide, that prevents or mitigates in vivo proteolytic degradation or other activity-diminishing chemical modification of the toxin peptide, increases half-life or other pharmacokinetic properties such as but not limited to increasing the rate of absorption, reduces toxicity, improves solubility, increases biological activity and/or target selectivity of the toxin peptide with respect to a target ion channel of interest, increases manufacturability, and/or reduces immunogenicity of the toxin peptide, compared to an unconjugated form of the toxin peptide.

By "PEGylated peptide" is meant a peptide or protein having a polyethylene glycol (PEG) moiety covalently bound to an amino acid residue of the peptide itself or to a peptidyl or non-peptidyl linker (including but not limited to aromatic linkers) that is covalently bound to a residue of the peptide.

By "polyethylene glycol" or "PEG" is meant a polyalkylene glycol compound or a derivative thereof, with or without coupling agents or derivatization with coupling or activating moieties (e.g., with aldehyde, hydroxysuccinimidyl, hydrazide, thiol, triflate, tresylate, azirdine, oxirane, orthopyridyl disulphide, vinylsulfone, iodoacetamide or a maleimide moiety). In accordance with the present invention, useful PEG includes substantially linear, straight chain PEG, branched PEG, or dendritic PEG. (See, e.g., Merrill, U.S. Pat. No. 5,171,264; Harris et al., Multiarmed, monofunctional, polymer for coupling to molecules and surfaces, U.S. Pat. No. 5,932,462; Shen, N-maleimidyl polymer derivatives, U.S. Pat. No. 6,602,498).

The term "peptibody" refers to molecules of Formula I in which $F^1$ and/or $F^2$ is an immunoglobulin Fc domain or a portion thereof, such as a CH2 domain of an Fc, or in which the toxin peptide is inserted into a human IgG1 Fc domain loop, such that $F^1$ and $F^2$ are each a portion of an Fc domain with a toxin peptide inserted between them (See, e.g., FIGS. 70-73 and Example 49 herein). Peptibodies of the present invention can also be PEGylated as described further herein, at either an Fc domain or portion thereof, or at the toxin peptide(s) portion of the inventive composition, or both.

The term "native Fc" refers to molecule or sequence comprising the sequence of a non-antigen-binding fragment resulting from digestion of whole antibody, whether in monomeric or multimeric form. The original immunoglobulin source of the native Fc is preferably of human origin and can be any of the immunoglobulins, although IgG1 or IgG2 are preferred. Native Fc's are made up of monomeric polypeptides that can be linked into dimeric or multimeric forms by covalent (i.e., disulfide bonds) and non-covalent association. The number of intermolecular disulfide bonds between monomeric subunits of native Fc molecules ranges from 1 to 4 depending on class (e.g., IgG, IgA, IgE) or subclass (e.g., IgG1, IgG2, IgG3, IgA1, IgGA2). One example of a native Fc is a disulfide-bonded dimer resulting from papain digestion of an IgG (see Ellison et al. (1982), *Nucleic Acids Res.* 10: 4071-9). The term "native Fc" as used herein is generic to the monomeric, dimeric, and multimeric forms.

The term "Fc variant" refers to a molecule or sequence that is modified from a native Fc but still comprises a binding site for the salvage receptor, FcRn. Several published patent documents describe exemplary Fc variants, as well as interaction with the salvage receptor. See International applications WO 97/34 631 (published 25 Sep. 1997; WO 96/32 478, corresponding to U.S. Pat. No. 6,096,891, issued Aug. 1, 2000, hereby incorporated by reference in its entirety; and WO 04/110 472. Thus, the term "Fc variant" includes a molecule or sequence that is humanized from a non-human native Fc. Furthermore, a native Fc comprises sites that can be removed because they provide structural features or biological activity that are not required for the fusion molecules of the present invention. Thus, the term "Fc variant" includes a molecule or sequence that lacks one or more native Fc sites or residues that affect or are involved in (1) disulfide bond formation, (2) incompatibility with a selected host cell (3) N-terminal heterogeneity upon expression in a selected host cell, (4) glycosylation, (5) interaction with complement, (6) binding to an Fc receptor other than a salvage receptor, or (7) antibody-dependent cellular cytotoxicity (ADCC). Fc variants are described in further detail hereinafter.

The term "Fc domain" encompasses native Fc and Fc variant molecules and sequences as defined above. As with Fc variants and native Fc's, the term "Fc domain" includes molecules in monomeric or multimeric form, whether digested from whole antibody or produced by other means.

The term "multimer" as applied to Fc domains or molecules comprising Fc domains refers to molecules having two or more polypeptide chains associated covalently, noncovalently, or by both covalent and non-covalent interactions. IgG molecules typically form dimers; IgM, pentamers; IgD, dimers; and IgA, monomers, dimers, trimers, or tetramers. One skilled in the art can form multimers by exploiting the sequence and resulting activity of the native Ig source of the Fc or by derivatizing (as defined below) such a native Fc.

Figure 1A:
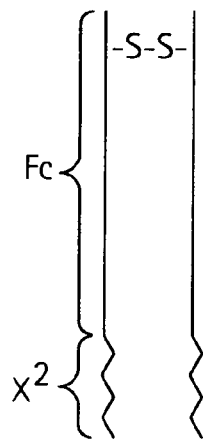
FIG. 1A and FIG. 1D: Single disulfide-bonded dimers.
Figure 1B:
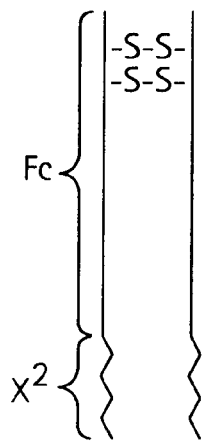
FIG. 1B and FIG. 1E: Doubly disulfide-bonded dimers.
Figure 1C:
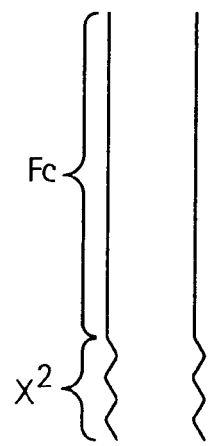
FIG. 1C and FIG. 1F: Noncovalent dimers.
Figure 1D:
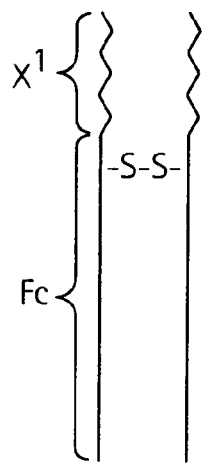
Figure 1E:
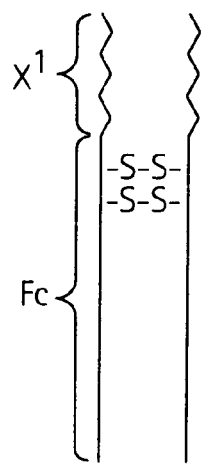
Figure 1F:
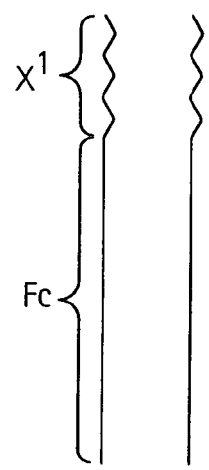
Figure 2A:
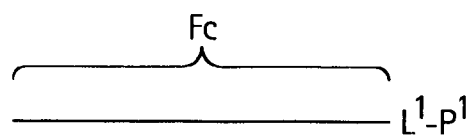
FIG. 2A shows a single chain molecule and can also represent the DNA construct for the molecule.
Figure 2B:
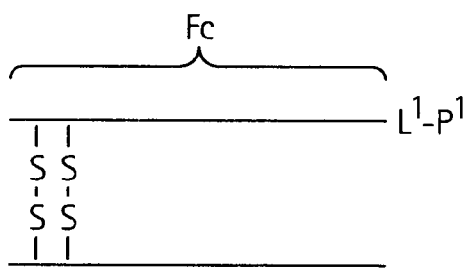
FIG. 2B shows a dimer in which the linker-peptide portion is present on only one chain of the dimer.
Figure 2C:
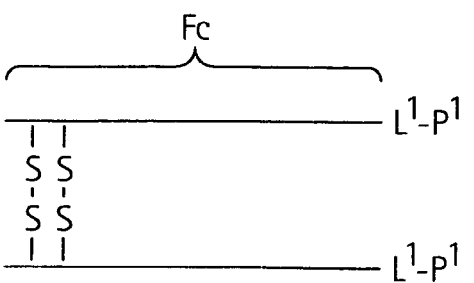
FIG. 2C shows a dimer having the peptide portion on both chains. The dimer of FIG. 2C will form spontaneously in certain host cells upon expression of a DNA construct encoding the single chain shown in FIG. 2A. In other host cells, the cells could be placed in conditions favoring formation of dimers or the dimers can be formed in vitro.

The term "dimer" as applied to Fc domains or molecules comprising Fc domains refers to molecules having two polypeptide chains associated covalently or non-covalently. Thus, exemplary dimers within the scope of this invention are as shown in FIG. 2.

The terms "derivatizing" and "derivative" or "derivatized" comprise processes and resulting compounds respectively in which (1) the compound has a cyclic portion; for example, cross-linking between cysteinyl residues within the compound; (2) the compound is cross-linked or has a cross-linking site; for example, the compound has a cysteinyl residue and thus forms cross-linked dimers in culture or in vivo; (3) one or more peptidyl linkage is replaced by a non-peptidyl linkage; (4) the N-terminus is replaced by —NRR$^1$, NRC(O)R$^1$, —NRC(O)OR$^1$, —NRS(O)$_2$R$^1$, —NHC(O)NHR, a succinimide group, or substituted or unsubstituted benzyloxycarbonyl-NH—, wherein R and R$^1$ and the ring substituents are as defined hereinafter; (5) the C-terminus is replaced by —C(O)R$^2$ or —NR$^3$R$^4$ wherein R$^2$, R$^3$ and R$^4$ are as defined hereinafter; and (6) compounds in which individual amino acid moieties are modified through treatment with agents capable of reacting with selected side chains or terminal residues. Derivatives are further described hereinafter.

The term "peptide" refers to molecules of 2 to about 80 amino acid residues, with molecules of about 10 to about 60 amino acid residues preferred and those of about 30 to about 50 amino acid residuess most preferred. Exemplary peptides can be randomly generated by any known method, carried in a peptide library (e.g., a phage display library), or derived by digestion of proteins. In any peptide portion of the inventive compositions, for example a toxin peptide or a peptide linker moiety described herein, additional amino acids can be included on either or both of the N- or C-termini of the given sequence. Of course, these additional amino acid residues should not significantly interfere with the functional activity of the composition. "Toxin peptides" include peptides having the same amino acid sequence of a naturally occurring pharmacologically active peptide that can be isolated from a venom, and also include modified peptide analogs of such naturally occurring molecules. Examples of toxin peptides useful in practicing the present invention are listed in Tables 1-32. The toxin peptide ("P", or equivalently shown as "P$^1$" in FIG. 2) comprises at least two intrapeptide disulfide bonds, as shown, for example, in FIG. 9. Accordingly, this invention concerns molecules comprising:

a) $C^1$-$C^3$ and $C^2$-$C^4$ disulfide bonding in which $C^1$, $C^2$, $C^3$, and $C^4$ represent the order in which cysteine residues appear in the primary sequence of the toxin peptide stated conventionally with the N-terminus of the peptide on the left, with the first and third cysteines in the amino acid sequence forming a disulfide bond, and the second and fourth cysteines forming a disulfide bond. Examples of toxin peptides with such a $C^1$-$C^3$, $C^2$-$C^4$ disulfide bonding pattern include, but are not limited to, apamin peptides, α-conopeptides, PnIA peptides, PnIB peptides, and MII peptides, and analogs of any of the foregoing.

b) $C^1$-$C^6$, $C^2$-$C^4$ and $C^3$-$C^5$ disulfide bonding in which, as described above, $C^1$, $C^2$, $C^3$, $C^4$, $C^5$ and $C^6$ represent the order of cysteine residues appearing in the primary sequence of the toxin peptide stated conventionally with the N-terminus of the peptide(s) on the left, with the first and sixth cysteines in the amino acid sequence forming a disulfide bond, the second and fourth cysteines forming a disulfide bond, and the third and fifth cysteines forming a disulfide bond. Examples of toxin peptides with such a $C^1$-$C^6$, $C^2$-$C^4$, $C^3$-$C^5$ disulfide bonding pattern include, but are not limited to, ShK, BgK, HmK, AeKS, AsK, and DTX1, and analogs of any of the foregoing.

c) $C^1$-$C^4$, $C^2$-$C^5$ and $C^3$-$C^6$ disulfide bonding in which, as described above, $C^1$, $C^2$, $C^3$, $C^4$, $C^5$ and $C^6$ represent the order of cysteine residues appearing in the primary sequence of the toxin peptide stated conventionally with the N-terminus of the peptide(s) on the left, with the first and fourth cysteines in the amino acid sequence forming a disulfide bond, the second and fifth cysteines forming a disulfide bond, and the third and sixth cysteines forming a disulfide bond. Examples of toxin peptides with such a $C^1$-$C^4$, $C^2$-$C^5$, $C^3$-$C^6$ disulfide bonding pattern include, but are not limited to, ChTx, MgTx, OSK1, KTX1, AgTx2, Pi2, Pi3, NTX, HgTx1, BeKM1, BmKTX, P01, BmKK6, Tc32, Tc1, BmTx1, BmTX3, IbTx, P05, ScyTx, TsK, HaTx1, ProTX1, PaTX2, Ptu1, ωGVIA, ωMVIIA, and SmIIIa, and analogs of any of the foregoing.

d) $C^1$-$C^5$, $C^2$-$C^6$, $C^3$-$C^7$, and $C^4$-$C^8$ disulfide bonding in which $C^1$, $C^2$, $C^3$, $C^4$, $C^5$, $C^6$, $C^7$ and $C^8$ represent the order of cysteine residues appearing in the primary sequence of the toxin peptide stated conventionally with the N-terminus of the peptide(s) on the left, with the first and fifth cysteines in the amino acid sequence forming a disulfide bond, the second and sixth cysteines forming a disulfide bond, the third and seventh cysteines forming a disulfide bond, and the fourth and eighth cysteines forming a disulfide bond. Examples of toxin peptides with such a $C^1$-$C^5$, $C^2$-$C^6$, $C^3$-$C^7$, $C^4$-$C^8$ disulfide bonding pattern include, but are not limited to, Anuoroctoxin (AnTx), Pi1, HsTx1, MTX (P12A, P20A), and Pi4 peptides, and analogs of any of the foregoing.

e) $C^1$-$C^4$, $C^2$-$C^6$, $C^3$-$C^7$, and $C^5$-$C^8$ disulfide bonding in which $C^1$, $C^2$, $C^3$, $C^4$, $C^5$, $C^6$, $C^7$ and $C^8$ represent the order of cysteine residues appearing in the primary sequence of the toxin peptide stated conventionally with the N-terminus of the peptide(s) on the left, with the first and fourth cysteines in the amino acid sequence forming a disulfide bond, the second and sixth cysteines forming a disulfide bond, the third and seventh cysteines forming a disulfide bond, and the fifth and eighth cysteines forming a disulfide bond. Examples of toxin peptides with such a $C^1$-$C^4$, $C^2$-$C^6$, $C^3$-$C^7$, $C^5$-$C^8$ disulfide bonding pattern include, but are not limited to, Chlorotoxin, Bm-12b, and, and analogs of either.

f) $C^1$-$C^5$, $C^2$-$C^6$, $C^3$-$C^4$, and $C^7$-$C^8$ disulfide bonding in which $C^1$, $C^2$, $C^3$, $C^4$, $C^5$, $C^6$, $C^7$ and $C^8$ represent the order of cysteine residues appearing in the primary sequence of the toxin peptide stated conventionally with the N-terminus of the peptide(s) on the left, with the first and fifth cysteines in the amino acid sequence forming a disulfide bond, the second and sixth cysteines forming a disulfide bond, the third and fourth cysteines forming a disulfide bond, and the seventh and eighth cysteines forming a disulfide bond. Examples of toxin peptides with such a $C^1$-$C^5$, $C^2$-$C^6$, $C^3$-$C^4$, $C^7$-$C^8$ disulfide bonding pattern include, but are not limited to, Maurotoxin peptides and analogs thereof.

The term "randomized" as used to refer to peptide sequences refers to fully random sequences (e.g., selected by phage display methods) and sequences in which one or more residues of a naturally occurring molecule is replaced by an amino acid residue not appearing in that position in the naturally occurring molecule. Exemplary methods for identifying peptide sequences include phage display, E. coli display, ribosome display, yeast-based screening, RNA-peptide screening, chemical screening, rational design, protein structural analysis, and the like.

The term "pharmacologically active" means that a substance so described is determined to have activity that affects a medical parameter (e.g., blood pressure, blood cell count, cholesterol level) or disease state (e.g., cancer, autoimmune disorders). Thus, pharmacologically active peptides comprise agonistic or mimetic and antagonistic peptides as defined below.

The terms "-mimetic peptide" and "-agonist peptide" refer to a peptide having biological activity comparable to a naturally occurring toxin peptide molecule, e.g., naturally occurring ShK toxin peptide. These terms further include peptides that indirectly mimic the activity of a naturally occurring toxin peptide molecule, such as by potentiating the effects of the naturally occurring molecule.

The term "-antagonist peptide" or "inhibitor peptide" refers to a peptide that blocks or in some way interferes with the biological activity of a receptor of interest, or has biological activity comparable to a known antagonist or inhibitor of a receptor of interest (such as, but not limited to, an ion channel).

The term "acidic residue" refers to amino acid residues in D- or L-form having sidechains comprising acidic groups. Exemplary acidic residues include D and E.

The term "amide residue" refers to amino acids in D- or L-form having sidechains comprising amide derivatives of acidic groups. Exemplary residues include N and Q.

The term "aromatic residue" refers to amino acid residues in D- or L-form having sidechains comprising aromatic groups. Exemplary aromatic residues include F, Y, and W.

The term "basic residue" refers to amino acid residues in D- or L-form having sidechains comprising basic groups. Exemplary basic residues include H, K, R, N-methyl-arginine, ω-aminoarginine, ω-methyl-arginine, 1-methyl-histidine, 3-methyl-histidine, and homoarginine (hR) residues.

The term "hydrophilic residue" refers to amino acid residues in D- or L-form having sidechains comprising polar groups. Exemplary hydrophilic residues include C, S, T, N, Q, D, E, K, and citrulline (Cit) residues.

The term "nonfunctional residue" refers to amino acid residues in D- or L-form having sidechains that lack acidic, basic, or aromatic groups. Exemplary nonfunctional amino acid residues include M, G, A, V, I, L and norleucine (Nle).

The term "neutral polar residue" refers to amino acid residues in D- or L-form having sidechains that lack basic, acidic, or polar groups. Exemplary neutral polar amino acid residues include A, V, L, I, P, W, M, and F.

The term "polar hydrophobic residue" refers to amino acid residues in D- or L-form having sidechains comprising polar groups. Exemplary polar hydrophobic amino acid residues include T, G, S, Y, C, Q, and N.

The term "hydrophobic residue" refers to amino acid residues in D- or L-form having sidechains that lack basic or acidic groups. Exemplary hydrophobic amino acid residues include A, V, L, I, P, W, M, F, T, G, S, Y, C, Q, and N.

In some useful embodiments of the compositions of the invention, the amino acid sequence of the toxin peptide is modified in one or more ways relative to a native toxin peptide sequence of interest, such as, but not limited to, a native ShK or OSK1 sequence, their peptide analogs, or any other toxin peptides having amino acid sequences as set for in any of Tables 1-32. The one or more useful modifications can include amino acid additions or insertions, amino acid deletions, peptide truncations, amino acid substitutions, and/or chemical derivatization of amino acid residues, accomplished by known chemical techniques. Such modifications can be, for example, for the purpose of enhanced potency, selectivity, and/or proteolytic stability, or the like. Those skilled in the art are aware of techniques for designing peptide analogs with such enhanced properties, such as alanine scanning, rational design based on alignment mediated mutagenesis using known toxin peptide sequences and/or molecular modeling. For example, ShK analogs can be designed to remove protease cleavage sites (e.g., trypsin cleavage sites at K or R residues and/or chymotrypsin cleavage sites at F, Y, or W residues) in a ShK peptide- or ShK analog-containing composition of the invention, based partially on alignment mediated mutagenesis using HmK (see, e.g., FIG. 6) and molecular modeling. (See, e.g., Kalman et al., ShK-Dap22, a potent Kv1.3-specific immunosuppressive polypeptide, J. Biol. Chem. 273(49):32697-707 (1998); Kem et al., U.S. Pat. No. 6,077,680; Mouhat et al., *OsK1 derivatives*, WO 2006/002850 A2)).

The term "protease" is synonymous with "peptidase". Proteases comprise two groups of enzymes: the endopeptidases which cleave peptide bonds at points within the protein, and the exopeptidases, which remove one or more amino acids from either N- or C-terminus respectively. The term "proteinase" is also used as a synonym for endopeptidase. The four mechanistic classes of proteinases are: serine proteinases, cysteine proteinases, aspartic proteinases, and metallo-proteinases. In addition to these four mechanistic classes, there is a section of the enzyme nomenclature which is allocated for proteases of unidentified catalytic mechanism. This indicates that the catalytic mechanism has not been identified.

Cleavage subsite nomenclature is commonly adopted from a scheme created by Schechter and Berger (Schechter I. & Berger A., On the size of the active site in proteases. I. Papain, Biochemical and Biophysical Research Communication, 27:157 (1967); Schechter I. & Berger A., On the active site of proteases. 3. Mapping the active site of papain; specific inhibitor peptides of papain, Biochemical and Biophysical Research Communication, 32:898 (1968)). According to this model, amino acid residues in a substrate undergoing cleavage are designated P1, P2, P3, P4 etc. in the N-terminal direction from the cleaved bond. Likewise, the residues in the C-terminal direction are designated P1', P2', P3', P4'. etc.

The skilled artisan is aware of a variety of tools for identifying protease binding or protease cleavage sites of interest. For example, the PeptideCutter software tool is available through the ExPASy (Expert Protein Analysis System) proteomics server of the Swiss Institute of Bioinformatics (SIB; www.expasy.org/tools/peptidecutter). PeptideCutter searches a protein sequence from the SWISS-PROT and/or TrEMBL databases or a user-entered protein sequence for protease cleavage sites. Single proteases and chemicals, a selection or the whole list of proteases and chemicals can be used. Different forms of output of the results are available: tables of cleavage sites either grouped alphabetically according to enzyme names or sequentially according to the amino acid number. A third option for output is a map of cleavage sites. The sequence and the cleavage sites mapped onto it are grouped in blocks, the size of which can be chosen by the user. Other tools are also known for determining protease cleavage sites. (E.g., Turk, B. et al., Determination of protease cleavage site motifs using mixture-based oriented peptide libraries, Nature Biotechnology, 19:661-667 (2001); Barrett A. et al., Handbook of proteolytic enzymes, Academic Press (1998)).

The serine proteinases include the chymotrypsin family, which includes mammalian protease enzymes such as chymotrypsin, trypsin or elastase or kallikrein. The serine proteinases exhibit different substrate specificities, which are related to amino acid substitutions in the various enzyme subsites interacting with the substrate residues. Some enzymes have an extended interaction site with the substrate whereas others have a specificity restricted to the P1 substrate residue.

Trypsin preferentially cleaves at R or K in position P1. A statistical study carried out by Keil (1992) described the negative influences of residues surrounding the Arg- and Lys- bonds (i.e. the positions P2 and P1', respectively) during trypsin cleavage. (Keil, B., Specificity of proteolysis, Springer-Verlag Berlin-Heidelberg-New York, 335 (1992)). A proline residue in position P1' normally exerts a strong negative influence on trypsin cleavage. Similarly, the positioning of R and K in P1' results in an inhibition, as well as negatively charged residues in positions P2 and P1'.

Chymotrypsin preferentially cleaves at a W, Y or F in position P1 (high specificity) and to a lesser extent at L, M or H residue in position P1. (Keil, 1992). Exceptions to these rules are the following: When W is found in position P1, the cleavage is blocked when M or P are found in position P1' at the same time. Furthermore, a proline residue in position P1' nearly fully blocks the cleavage independent of the amino acids found in position P1. When an M residue is found in position P1, the cleavage is blocked by the presence of a Y residue in position P1'. Finally, when H is located in position P1, the presence of a D, M or W residue also blocks the cleavage.

Membrane metallo-endopeptidase (NEP; neutral endopeptidase, kidney-brush-border neutral proteinase, enkephalinase, EC 3.4.24.11) cleaves peptides at the amino side of hydrophobic amino acid residues. (Connelly, J C et al., Neutral Endopeptidase 24.11 in Human Neutrophils: Cleavage of Chemotactic Peptide, PNAS, 82(24):8737-8741 (1985)).

Thrombin preferentially cleaves at an R residue in position P1. (Keil, 1992). The natural substrate of thrombin is fibrinogen. Optimum cleavage sites are when an R residue is in position P1 and Gly is in position P2 and position P1'. Likewise, when hydrophobic amino acid residues are found in position P4 and position P3, a proline residue in position P2, an R residue in position P1, and non-acidic amino acid residues in position P1' and position P2'. A very important residue for its natural substrate fibrinogen is a D residue in P10.

Caspases are a family of cysteine proteases bearing an active site with a conserved amino acid sequence and which cleave peptides specifically following D residues. (Earnshaw W C et al., Mammalian caspases: Structure, activation, substrates, and functions during apoptosis, Annual Review of Biochemistry, 68:383-424 (1999)).

The Arg-C proteinase preferentially cleaves at an R residue in position P1. The cleavage behavior seems to be only moderately affected by residues in position P1'. (Keil, 1992). The Asp-N endopeptidase cleaves specifically bonds with a D residue in position P1'. (Keil, 1992).

The foregoing is merely exemplary and by no means an exhaustive treatment of knowledge available to the skilled artisan concerning protease binding and/or cleavage sites that the skilled artisan may be interested in eliminating in practicing the invention.

In other examples, a toxin peptide amino acid sequence modified from a naturally occurring toxin peptide amino acid sequence includes at least one amino acid residue inserted or substituted therein, relative to the amino acid sequence of the native toxin peptide sequence of interest, in which the inserted or substituted amino acid residue has a side chain comprising a nucleophilic or electrophilic reactive functional group by which the peptide is conjugated to a linker or half-life extending moiety. In accordance with the invention, useful examples of such a nucleophilic or electrophilic reactive functional group include, but are not limited to, a thiol, a primary amine, a seleno, a hydrazide, an aldehyde, a carboxylic acid, a ketone, an aminooxy, a masked (protected) aldehyde, or a masked (protected) keto functional group. Examples of amino acid residues having a side chain comprising a nucleophilic reactive functional group include, but are not limited to, a lysine residue, an α,β-diaminopropionic acid residue, an α,γ-diaminobutyric acid residue, an ornithine residue, a cysteine, a homocysteine, a glutamic acid residue, an aspartic acid residue, or a selenocysteine residue.

In further describing toxin peptides herein, a one-letter abbreviation system is frequently applied to designate the identities of the twenty "canonical" amino acid residues generally incorporated into naturally occurring peptides and proteins (Table 1A). Such one-letter abbreviations are entirely interchangeable in meaning with three-letter abbreviations, or non-abbreviated amino acid names. Within the one-letter abbreviation system used herein, an uppercase letter indicates a L-amino acid, and a lower case letter indicates a D-amino acid, unless otherwise noted herein. For example, the abbreviation "R" designates L-arginine and the abbreviation "r" designates D-arginine.

TABLE 1A

One-letter abbreviations for the canonical amino acids.
Three-letter abbreviations are in parentheses.

| | |
|---|---|
| Alanine (Ala) | A |
| Glutamine (Gln) | Q |
| Leucine (Leu) | L |
| Serine (Ser) | S |
| Arginine (Arg) | R |
| Glutamic Acid (Glu) | E |
| Lysine (Lys) | K |
| Threonine (Thr) | T |
| Asparagine (Asn) | N |
| Glycine (Gly) | G |
| Methionine (Met) | M |
| Tryptophan (Trp) | W |
| Aspartic Acid (Asp) | D |
| Histidine (His) | H |
| Phenylalanine (Phe) | F |
| Tyrosine (Tyr) | Y |
| Cysteine (Cys) | C |
| Isoleucine (Ile) | I |
| Proline (Pro) | P |
| Valine (Val) | V |

An amino acid substitution in an amino acid sequence is typically designated herein with a one-letter abbreviation for the amino acid residue in a particular position, followed by the numerical amino acid position relative to the native toxin peptide sequence of interest, which is then followed by the one-letter symbol for the amino acid residue substituted in. For example, "T30D" symbolizes a substitution of a threonine residue by an aspartate residue at amino acid position 30, relative to a hypothetical native toxin peptide sequence. By way of further example, "R18hR" or "R18Cit" indicates a substitution of an arginine residue by a homoarginine or a citrulline residue, respectively, at amino acid position 18, relative to the hypothetical native toxin peptide. An amino acid position within the amino acid sequence of any particular toxin peptide (or peptide analog) described herein may differ from its position relative to the native sequence, i.e., as determined in an alignment of the N-terminal or C-terminal end of the peptide's amino acid sequence with the N-terminal or C-terminal end, as appropriate, of the native toxin peptide sequence. For example, amino acid position 1 of the sequence SCIDTIPKSRCTAFQCKHSMKYRLSFCRKTCGTC(ShK (2-35); SEQ ID NO:92), a N-terminal truncation of the native ShK sequence, thus aligned with the C-terminal of native ShK(1-35) (SEQ ID NO:5), corresponds to amino acid position 2 relative to the native sequence, and amino acid position 34 of SEQ ID NO:92 corresponds to amino acid position 35 relative to the native sequence (SEQ ID NO:5).

In certain embodiments of the present invention, amino acid substitutions encompass, non-canonical amino acid residues, which can include naturally rare (in peptides or proteins) amino acid residues or unnatural amino acid residues. Non-canonical amino acid residues can be incorporated into the peptide by chemical peptide synthesis rather than by synthesis in biological systems, such as recombinantly expressing cells, or alternatively the skilled artisan can employ known techniques of protein engineering that use recombinantly expressing cells. (See, e.g., Link et al., Non-canonical amino acids in protein engineering, Current Opinion in Biotechnology, 14(6):603-609 (2003)). The term "non-canonical amino acid residue" refers to amino acid residues in D- or L-form that are not among the 20 canonical amino acids generally incorporated into naturally occurring proteins, for example, β-amino acids, homoamino acids, cyclic amino acids and amino acids with derivatized side chains. Examples include (in the L-form or D-form): citrulline (Cit), homocitrulline (hCit), N-methylcitrulline (NMeCit), N-methylhomocitrulline (NMeHoCit), ornithine (Orn or O), N-Methylornithine (NMeOrn), sarcosine (Sar), homolysine (hK or Hlys), homoarginine (hR or hArg), homoglutamine (hQ), N-methylarginine (NMeR), N-methylleucine (NMeL), N-methylhomolysine (NMeHoK), N-methylglutamine (NMeQ), norleucine (Nle), norvaline (Nva), 1,2,3,4-tetrahydroisoquinoline (Tic), nitrophenylalanine (nitrophe), aminophenylalanine (aminophe), benzylphenyalanine (benzylphe), γ-carboxyglutamic acid (γ-carboxyglu), hydroxyproline (hydroxypro), p-carboxyl-phenylalanine (Cpa), α-aminoadipic acid (Aad), acetylarginine (acetylarg), α,β-diaminopropionoic acid (Dpr), α,γ-diaminobutyric acid (Dab), diaminopropionic acid (Dap), β-(1-Naphthyl)-alanine (1Na1), β-(2-Naphthyl)-alanine (2Na1), cyclohexylalanine (Cha), 4-methyl-phenylalanine (MePhe), β,β-diphenyl-alanine (BiPhA), aminobutyric acid (Abu), 4-phenyl-phenylalanine (4Bip), α-amino-isobutyric acid (Aib), and derivatized forms of any of these as described herein. Nomenclature and Symbolism for Amino Acids and Peptides by the UPAC-IUB Joint Commission on Biochemical Nomenclature (JCBN) have been published in the following documents: Biochem. J., 1984, 219, 345-373; Eur. J. Biochem., 1984, 138, 9-37; 1985, 152, 1; 1993, 213, 2; Internat. J. Pept. Prot. Res., 1984, 24, following p 84; J. Biol. Chem., 1985, 260, 14-42; Pure Appl. Chem., 1984, 56, 595-624; Amino Acids and Peptides, 1985, 16, 387-410; Biochemical Nomenclature and Related Documents, 2nd edition, Portland Press, 1992, pages 39-69].

As stated herein, in accordance with the present invention, peptide portions of the inventive compositions, such as the toxin peptide or a peptide linker, can also be chemically derivatized at one or more amino acid residues. Peptides that contain derivatized amino acid residues can be synthesized by known organic chemistry techniques. "Chemical derivative" or "chemically derivatized" in the context of a peptide refers to a subject peptide having one or more residues chemically derivatized by reaction of a functional side group. Such derivatized molecules include, for example, those molecules in which free amino groups have been derivatized to form amine hydrochlorides, p-toluene sulfonyl groups, carbobenzoxy groups, t-butyloxycarbonyl groups, chloroacetyl groups or formyl groups. Free carboxyl groups may be derivatized to form salts, methyl and ethyl esters or other types of esters or hydrazides. Free hydroxyl groups may be derivatized to form O-acyl or O-alkyl derivatives. The imidazole nitrogen of histidine may be derivatized to form N-im-benzylhistidine. Also included as chemical derivatives are those peptides which contain one or more naturally occurring amino acid derivatives of the twenty canonical amino acids, whether in L- or D-form. For example, 4-hydroxyproline may be substituted for proline; 5-hydroxylysine maybe substituted for lysine; 3-methylhistidine may be substituted for histidine; homoserine may be substituted for serine; and ornithine may be substituted for lysine.

In some embodiments of the present invention, basic residues (e.g., lysine) of the toxin peptide of interest can be replaced with other residues (nonfunctional residues preferred). Such molecules will be less basic than the molecules from which they are derived and otherwise retain the activity of the molecules from which they are derived, which can result in advantages in stability and immunogenicity; the present invention should not, however, be limited by this theory.

Additionally, physiologically acceptable salts of the inventive compositions are also encompassed, including when the inventive compositons are referred to herein as "molecules"

or "compounds.". By "physiologically acceptable salts" is meant any salts that are known or later discovered to be pharmaceutically acceptable. Some examples are: acetate; trifluoroacetate; hydrohalides, such as hydrochloride and hydrobromide; sulfate; citrate; maleate; tartrate; glycolate; gluconate; succinate; mesylate; besylate; and oxalate salts.

Structure of Compounds:

In General. Recombinant proteins have been developed as therapeutic agents through, among other means, covalent attachment to half-life extending moieties. Such moieties include the "Fc" domain of an antibody, as is used in Enbrel® (etanercept), as well as biologically suitable polymers (e.g., polyethylene glycol, or "PEG"), as is used in Neulasta® (pegfilgrastim). Feige et al. described the use of such half-life extenders with peptides in U.S. Pat. No. 6,660,843, issued Dec. 9, 2003 (hereby incorporated by reference in its entirety).

The present inventors have determined that molecules of this invention—peptides of about 80 amino acids or less with at least two intrapeptide disulfide bonds—possess therapeutic advantages when covalently attached to half-life extending moieties. Molecules of the present invention can further comprise an additional pharmacologically active, covalently bound peptide, which can be bound to the half-life extending moiety ($F^1$ and/or $F^2$) or to the peptide portion (P). Embodiments of the inventive compositions containing more than one half-life extending moiety ($F^1$ and $F^2$) include those in which $F^1$ and $F^2$ are the same or different half-life extending moieties. Examples (with or without a linker between each domain) include structures as illustrated in FIG. 75 as well as the following embodiments (and others described herein and in the working Examples):

20KPEG—toxin peptide—Fc domain, consistent with the formula $[(F^1)_1-(X^2)_1-(F^2)_1]$;

20KPEG—toxin peptide—Fc CH2 domain, consistent with the formula $[(F^1)_1-(X^2)_1-(F^2)_1]$;

20KPEG—toxin peptide—HSA, consistent with the formula $[(F^1)_1-(X^2)_1-(F^2)_1]$;

20KPEG—Fc domain—toxin peptide, consistent with the formula $[(F^1)_1-(F^2)_1-(X^3)_1]$;

20KPEG—Fc CH2 domain—toxin peptide, consistent with the formula $[(F^1)_1-(F^2)_1-(X^3)_1]$; and 20KPEG—HSA—toxin peptide, consistent with the formula $[(F^1)_1-(F^2)_1-(X^3)_1]$.

Toxin Peptides. Any number of toxin peptides (i.e., "P", or equivalently shown as "$P^1$" in FIG. 2) can be used in conjunction with the present invention. Of particular interest are the toxin peptides ShK, HmK, MgTx, AgTx2, OsK1 (also referred to as "OSK1"), Agatoxins, and HsTx1, as well as modified analogs of these, and other peptides that mimic the activity of such toxin peptides. As stated herein above, if more than one toxin peptide "P" is present in the inventive composition, "P" can be independently the same or different from any other toxin peptide(s) also present in the inventive composition. For example, in a composition having the formula $P-(L)_g-F^1-(L)_f-P$, both of the toxin peptides, "P", can be the same peptide analog of ShK, different peptide analogs of ShK, or one can be a peptide analog of ShK and the other a peptide analog of OSK1.

In some embodiments of the invention, other peptides of interest are especially useful in molecules having additional features over the molecules of structural Formula I. In such molecules, the molecule of Formula I further comprises an additional pharmacologically active, covalently bound peptide, which is an agonistic peptide, an antagonistic peptide, or a targeting peptide; this peptide can be conjugated to $F^1$ or $F^2$ or P. Such agonistic peptides have activity agonistic to the toxin peptide but are not required to exert such activity by the same mechanism as the toxin peptide. Peptide antagonists are also useful in embodiments of the invention, with a preference for those with activity that can be complementary to the activity of the toxin peptide. Targeting peptides are also of interest, such as peptides that direct the molecule to particular cell types, organs, and the like. These classes of peptides can be discovered by methods described in the references cited in this specification and other references. Phage display, in particular, is useful in generating toxin peptides for use in the present invention. Affinity selection from libraries of random peptides can be used to identify peptide ligands for any site of any gene product. Dedman et al. (1993), *J. Biol. Chem.* 268: 23025-30. Phage display is particularly well suited for identifying peptides that bind to such proteins of interest as cell surface receptors or any proteins having linear epitopes. Wilson et al. (1998), *Can. J. Microbiol.* 44: 313-29; Kay et al. (1998), *Drug Disc. Today* 3: 370-8. Such proteins are extensively reviewed in Herz et al. (1997), *J. Receptor and Signal Transduction Res.* 17(5): 671-776, which is hereby incorporated by reference in its entirety. Such proteins of interest are preferred for use in this invention.

Particularly preferred peptides appear in the following tables. These peptides can be prepared by methods disclosed in the art or as described hereinafter. Single letter amino acid abbreviations are used. Unless otherwise specified, each X is independently a nonfunctional residue.

TABLE 1

Kv1.3 inhibitor peptide sequences

| Sequence/structure | Shorthand designation | SEQ ID NO: |
|---|---|---|
| LVKCRGTSDCGRPCQQQTGCPNSKCINRMCKCYGC | Pi1 | 21 |
| TISCTNPKQCYPHCKKETGYPNAKCMNRKCKCFGR | Pi2 | 17 |
| TISCTNEKQCYPHCKKETGYPNAKCMNRKCKCFGR | Pi3 | 18 |
| IEAIRCGGSRDCYRPCQKRTGCPNAKCINKTCKCYGCS | Pi4 | 19 |
| ASCRTPKDCADPCRKETGCPYGKCMNRKCKCNRC | HsTx1 | 61 |
| GVPINVSCTGSPQCIKPCKDAGMRFGKCMNRKCHCTPK | AgTx2 | 23 |
| GVPINVKCTGSPQCLKPCKDAGMRFGKCINGKCHCTPK | AgTx1 | 85 |
| GVIINVKCKISRQCLEPCKKAGMRFGKCMNGKCHCTPK | OSK1 | 25 |
| ZKECTGPQHCTNFCRKNKCTHGKCMNRKCKCFNCK | Anuroctoxin | 62 |
| TIINVKCTSPKQCSKPCKELYGSSAGAKCMNGKCKCYNN | NTX | 30 |
| TVIDVKCTSPKQCLPPCKAQFGIRAGAKGMNGKCKCYPH | HgTx1 | 27 |
| QFTNVSCTTSKECWSVCQRLHNTSRGKCMNKKCRGYS | ChTx | 36 |
| VFINAKCRGSPECLPKCKEAIGKAAGKCMNGKCKCYP | Titystoxin-Ka | 86 |
| VCRDWFKETACRHAKSLGNCRTSQKYRANCAKTCELC | BgK | 9 |
| VGINVKCKHSGQCLKPCKDAGMRFGKCINGKCDCTPKG | BmKTX | 26 |
| QFTDVKCTGSKQCWPVCKQMFGKPNGKCMNGKCRCYS | BmTx1 | 40 |
| VFINVKCRGSKECLPACKAAVGKAAGKCMNGKCKCYP | Tc30 | 87 |
| TGPQTTCQAAMCEAGCKGLGKSMESCQGDTCKCKA | Tc32 | 13 |

TABLE 2

ShK peptide and ShK peptide analog sequences

| Sequence/structure | Shorthand designation | SEQ ID NO: |
|---|---|---|
| RSCIDTIPKSRCTAFQCKHSMKYRLSFCRKTCGTC | ShK | 5 |
| RSCIDTIPKSRCTAFQSKHSMKYRLSFCRKTSGTC | ShK-S17/S32 | 88 |
| RSSIDTIPKSRCTAFQCKHSMKYRLSFCRKTCGTS | ShK-S3/S35 | 89 |
| SSCIDTIPKSRCTAFQCKHSMKYRLSFCRKTCGTC | ShK-S1 | 90 |
| (N-acetylarg)SCIDTIPKSRCTAFQCKHSMKYRLSFCRKTCGTC | ShK-N-acetyl-arg1 | 91 |
| SCIDTIPKSRCTAFQCKHSMKYRLSFCRKTCGTC | ShK-d1 | 92 |
| CIDTIPKSRCTAFQCKHSMKYRLSFCRKTCGTC | ShK-d2 | 93 |
| ASCIDTIPKSRCTAFQCKHSMKYRLSFCRKTCGTC | ShK-A1 | 94 |
| RSCADTIPKSRCTAFQCKHSMKYRLSFCRKTCGTC | ShK-A4 | 95 |
| RSCADTIPKSRCTAAQCKHSMKYRLSFCRKTCGTC | ShK-A4/A15 | 96 |
| RSCADTIPKSRCTAAQCKHSMKYRASFCRKTCGTC | ShK-A4/A15/A25 | 97 |
| RSCIDAIPKSRCTAFQCKHSMKYRLSFCRKTCGTC | ShK-A6 | 98 |
| RSCIDTAPKSRCTAFQCKHSMKYRLSFCRKTCGTC | ShK-A7 | 99 |
| RSCIDTIAKSRCTAFQCKHSMKYRLSFCRKTCGTC | ShK-A8 | 100 |
| RSCIDTIPASRCTAFQCKHSMKYRLSFCRKTCGTC | ShK-A9 | 101 |
| RSCIDTIPESRCTAFQCKHSMKYRLSFCRKTCGTC | ShK-E9 | 102 |
| RSCIDTIPQSRCTAFQCKHSMKYRLSFCRKTCGTC | ShK-Q9 | 103 |
| RSCIDTIPKARCTAFQCKHSMKYRLSFCRKTCGTC | ShK-A10 | 104 |
| RSCIDTIPKSACTAFQCKHSMKYRLSFCRKTCGTC | ShK-A11 | 105 |
| RSCIDTIPKSECTAFQCKHSMKYRLSFCRKTCGTC | ShK-E11 | 106 |
| RSCIDTIPKSQCTAFQCKHSMKYRLSFCRKTCGTC | ShK-Q11 | 107 |
| RSCIDTIPKSRCAAFQCKHSMKYRLSFCRKTCGTC | ShK-A13 | 108 |
| RSCIDTIPKSRCTAAQCKHSMKYRLSFCRKTCGTC | ShK-A15 | 109 |
| RSCIDTIPKSRCTAWQCKHSMKYRLSFCRKTCGTC | ShK-W15 | 110 |
| RSCIDTIPKSRCTAX$^{s15}$QCKHSMKYRLSFCRKTCGTC | ShK-X15 | 111 |
| RSCIDTIPKSRCTAAQCKHSMKYRASFCRKTCGTC | ShK-A15/A25 | 112 |
| RSCIDTIPKSRCTAFACKHSMKYRLSFCRKTCGTC | ShK-A16 | 113 |
| RSCIDTIPKSRCTAFECKHSMKYRLSFCRKTCGTC | ShK-E16 | 114 |
| RSCIDTIPKSRCTAFQCAHSMKYRLSFCRKTCGTC | ShK-A18 | 115 |
| RSCIDTIPKSRCTAFQCEHSMKYRLSFCRKTCGTC | ShK-E18 | 116 |
| RSCIDTIPKSRCTAFQCKASMKYRLSFCRKTCGTC | ShK-A19 | 117 |
| RSCIDTIPKSRCTAFQCKKSMKYRLSFCRKTCGTC | ShK-K19 | 118 |
| RSCIDTIPKSRCTAFQCKHAMKYRLSFCRKTCGTC | ShK-A20 | 119 |
| RSCIDTIPKSRCTAFQCKHSAKYRLSFCRKTCGTC | ShK-A21 | 120 |
| RSCIDTIPKSRCTAFQCKHSX$^{s21}$KYRLSFCRKTCGTC | ShK-X21 | 121 |
| RSCIDTIPKSRCTAFQCKHS(norleu)KYRLSFCRKTCGTC | ShK-Nle21 | 122 |
| RSCIDTIPKSRCTAFQCKHSMAYRLSFCRKTCGTC | ShK-A22 | 123 |
| RSCIDTIPKSRCTAFQCKHSMEYRLSFCRKTCGTC | ShK-E22 | 124 |
| RSCIDTIPKSRCTAFQCKHSMRYRLSFCRKTCGTC | ShK-R22 | 125 |
| RSCIDTIPKSRCTAFQCKHSMX$^{s22}$YRLSFCRKTCGTC | ShK-X22 | 126 |
| RSCIDTIPKSRCTAFQCKHSM(norleu)YRLSFCRKTCGTC | ShK-Nle22 | 127 |
| RSCIDTIPKSRCTAFQCKHSM(orn)YRLSFCRKTCGTC | ShK-Orn22 | 128 |
| RSCIDTIPKSRCTAFQCKHSM(homocit)YRLSFCRKTCGTC | ShK-Homocit22 | 129 |
| RSCIDTIPKSRCTAFQCKHSM(diaminopropionic)YRLSFCRKTCGTC | ShK-Diaminopropionic22 | 130 |
| RSCIDTIPKSRCTAFQCKHSMKARLSFCRKTCGTC | ShK-A23 | 131 |
| RSCIDTIPKSRCTAFQCKHSMKSRLSFCRKTCGTC | ShK-S23 | 132 |
| RSCIDTIPKSRCTAFQCKHSMKFRLSFCRKTCGTC | ShK-F23 | 133 |
| RSCIDTIPKSRCTAFQCKHSMKX$^{s23}$RLSFCRKTCGTC | ShK-X23 | 134 |

TABLE 2-continued

ShK peptide and ShK peptide analog sequences

| Sequence/structure | Shorthand designation | SEQ ID NO: |
|---|---|---|
| RSCIDTIPKSRCTAFQCKHSMK(nitrophe)RLSFCRKTCGTC | ShK-Nitrophe23 | 135 |
| RSCIDTIPKSRCTAFQCKHSMK(aminophe)RLSFCRKTCGTC | ShK-Aminophe23 | 136 |
| RSCIDTIPKSRCTAFQCKHSMK(benzylphe)RLSFCRKTCGTC | ShK-Benzylphe23 | 137 |
| RSCIDTIPKSRCTAFQCKHSMKYALSFCRKTCGTC | ShK-A24 | 138 |
| RSCIDTIPKSRCTAFQCKHSMKYELSFCRKTCGTC | ShK-E24 | 139 |
| RSCIDTIPKSRCTAFQCKHSMKYRASFCRKTCGTC | ShK-A25 | 140 |
| RSCIDTIPKSRCTAFQCKHSMKYRLAFCRKTCGTC | ShK-A26 | 141 |
| RSCIDTIPKSRCTAFQCKHSMKYRLSACRKTCGTC | ShK-A27 | 142 |
| RSCIDTIPKSRCTAFQCKHSMKYRLSX$^{s27}$CRKTCGTC | ShK-X27 | 143 |
| RSCIDTIPKSRCTAFQCKHSMKYRLSFCAKTCGTC | ShK-A29 | 144 |
| RSCIDTIPKSRCTAFQCKHSMKYRLSFCRATCGTC | ShK-A30 | 145 |
| RSCIDTIPKSRCTAFQCKHSMKYRLSFCRKACGTC | ShK-A31 | 146 |
| RSCIDTIPKSRCTAFQCKHSMKYRLSFCRKTCGAC | ShK-A34 | 147 |
| SCADTIPKSRCTAFQCKHSMKYRLSFCRKTCGTC | ShK-A4d1 | 148 |
| SCADTIPKSRCTAAQCKHSMKYRLSFCRKTCGTC | ShK-A4/A15d1 | 149 |
| SCADTIPKSRCTAAQCKHSMKYRASFCRKTCGTC | ShK-A4/A15/A25 d1 | 150 |
| SCIDAIPKSRCTAFQCKHSMKYRLSFCRKTCGTC | ShK-A6 d1 | 151 |
| SCIDTAPKSRCTAFQCKHSMKYRLSFCRKTCGTC | ShK-A7 d1 | 152 |
| SCIDTIAKSRCTAFQCKHSMKYRLSFCRKTCGTC | ShK-A8 d1 | 153 |
| SCIDTIPASRCTAFQCKHSMKYRLSFCRKTCGTC | ShK-A9 d1 | 154 |
| SCIDTIPESRCTAFQCKHSMKYRLSFCRKTCGTC | ShK-E9 d1 | 155 |
| SCIDTIPQSRCTAFQCKHSMKYRLSFCRKTCGTC | ShK-Q9 d1 | 156 |
| SCIDTIPKARCTAFQCKHSMKYRLSFCRKTCGTC | ShK-A10 d1 | 157 |
| SCIDTIPKSACTAFQCKHSMKYRLSFCRKTCGTC | ShK-A11 d1 | 158 |
| SCIDTIPKSECTAFQCKHSMKYRLSFCRKTCGTC | ShK-E11 d1 | 159 |
| SCIDTIPKSQCTAFQCKHSMKYRLSFCRKTCGTC | ShK-Q11 d1 | 160 |
| SCIDTIPKSRCAAFQCKHSMKYRLSFCRKTCGTC | ShK-A13 d1 | 161 |
| SCIDTIPKSRCTAAQCKHSMKYRLSFCRKTCGTC | ShK-A15 d1 | 162 |
| SCIDTIPKSRCTAWQCKHSMKYRLSFCRKTCGTC | ShK-W15 d1 | 163 |
| SCIDTIPKSRCTAX$^{s15}$QCKHSMKYRLSFCRKTCGTC | ShK-X15 d1 | 164 |
| SCIDTIPKSRCTAAQCKHSMKYRASFCRKTCGTC | ShK-A15/A25 d1 | 165 |
| SCIDTIPKSRCTAFACKHSMKYRLSFCRKTCGTC | ShK-A16 d1 | 166 |
| SCIDTIPKSRCTAFECKHSMKYRLSFCRKTCGTC | ShK-E16 d1 | 167 |
| SCIDTIPKSRCTAFQCAHSMKYRLSFCRKTCGTC | ShK-A18 d1 | 168 |
| SCIDTIPKSRCTAFQCEHSMKYRLSFCRKTCGTC | ShK-E18 d1 | 169 |
| SCIDTIPKSRCTAFQCKASMKYRLSFCRKTCGTC | ShK-A19 d1 | 170 |
| SCIDTIPKSRCTAFQCKKSMKYRLSFCRKTCGTC | ShK-K19 d1 | 171 |
| SCIDTIPKSRCTAFQCKHAMKYRLSFCRKTCGTC | ShK-A20 d1 | 172 |
| SCIDTIPKSRCTAFQCKHSAKYRLSFCRKTCGTC | ShK-A21 d1 | 173 |
| SCIDTIPKSRCTAFQCKHSX$^{s21}$KYRLSFCRKTCGTC | ShK-X21 d1 | 174 |
| SCIDTIPKSRCTAFQCKHS(norleu)KYRLSPCRKTCGTC | ShK-Nle21 d1 | 175 |
| SCIDTIPKSRCTAFQCKHSMAYRLSFCRKTCGTC | ShK-A22 d1 | 176 |
| SCIDTIPKSRCTAFQCKHSMEYRLSFCRKTCGTC | ShK-E22 d1 | 177 |
| SCIDTIPKSRCTAFQCKHSMRYRLSFCRKTCGTC | ShK-R22 d1 | 178 |

TABLE 2-continued

ShK peptide and ShK peptide analog sequences

| Sequence/structure | Shorthand designation | SEQ ID NO: |
|---|---|---|
| SCIDTIPKSRCTAFQCKHSMX$^{s22}$YRLSFCRKTCGTC | ShK-X22 d1 | 179 |
| SCIDTIPKSRCTAFQCKHSM(norleu)YRLSFCRKTCGTC | ShK-Nle22 d1 | 180 |
| SCIDTIPKSRCTAFQCKHSM(orn)YRLSFCRKTCGTC | ShK-Orn22 d1 | 181 |
| SCIDTIPKSRCTAFQCKHSM(homocit)YRLSFCRKTCGTC | ShK-Homocit22 d1 | 182 |
| SCIDTIPKSRCTAFQCKHSM(diaminopropionic) YRLSFCRKTCGTC | ShK-Diaminopropionic22 d1 | 183 |
| SCIDTIPKSRCTAFQCKHSMKARLSFCRKTCGTC | ShK-A23 d1 | 184 |
| SCIDTIPKSRCTAFQCKHSMKSRLSFCRKTCGTC | ShK-S23 d1 | 185 |
| SCIDTIPKSRCTAFQCKHSMKFRLSFCRKTCGTC | ShK-F23 d1 | 186 |
| SCIDTIPKSRCTAFQCKHSMKX$^{s23}$RLSFCRKTCGTC | ShK-X23 d1 | 187 |
| SCIDTIPKSRCTAFQCKHSMK(nitrophe)RLSFCRKTCGTC | ShK-Nitrophe23 d1 | 188 |
| SCTDTIPKSRCTAFQCKHSMK(aminophe)RLSFCRKTCGTC | ShK-Aminophe23 d1 | 189 |
| SCIDTIPKSRCTAFQCKHSMK(benzylphe)RLSFCRKTCGTC | ShK-Benzylphe23 d1 | 190 |
| SCIDTIPKSRCTAFQCKHSMKYALSFCRKTCGTC | ShK-A24 d1 | 191 |
| SCIDTIPKSRCTAFQCKHSMKYELSFCRKTCGTC | ShK-E24 d1 | 192 |
| SCIDTIPKSRCTAFQCKHSMKYRASFCRKTCGTC | ShK-A25 d1 | 193 |
| SCIDTIPKSRCTAFQCKHSMKYRLAFCRKTCGTC | ShK-A26 d1 | 194 |
| SCIDTIPKSRCTAFQCKHSMKYRLSACRKTCGTC | ShK-A27 d1 | 195 |
| SCIDTIPKSRCTAFQCKHSMKYRLSXs27CRKTCGTC | ShK-X27 d1 | 196 |
| SCIDTIPKSRCTAFQCKHSMKYRLSFCAKTCGTC | ShK-A29 d1 | 197 |
| SCIDTIPKSRCTAFQCKHSMKYRLSFCRATCGTC | ShK-A30 d1 | 198 |
| SCIDTIPKSRCTAFQCKHSMKYRLSFCRKACGTC | ShK-A31 d1 | 199 |
| SCIDTIPKSRCTAFQCKHSMKYRLSFCRKTCGAC | ShK-A34 d2 | 200 |
| YSCIDTIPKSRCTAFQCKHSMKYRLSFCRKTCGTC | ShK-Y1 | 548 |
| KSCIDTIPKSRCTAFQCKHSMKYRLSFCRKTCGTC | ShK-K1 | 549 |
| HSCIDTIPKSRCTAFQCKHSNKYRLSFCRKTCGTC | ShK-H1 | 550 |
| QSCIDTIPKSRCTAFQCKHSMKYRLSFCRKTCGTC | ShK-Q1 | 551 |
| PPRSCIDTIPKSRCTAFQCKHSMKYRLSFCRKTCGTC | PP-ShK | 552 |
| MRSCIDTIPKSRCTAFQCKHSMKYRLSFCRKTCGTC | M-ShK | 553 |
| GRSCIDTIPKSRCTAFQCKHSMKYRLSFCRKTCGTC | G-ShK | 554 |
| YSCIDTIPKSRCTAFQCKHSMAYRLSFCRKTCGTC | ShK-Y1/A22 | 555 |
| KSCIDTIPKSRCTAFQCKHSMAYRLSFCRKTCGTC | ShK-K1/A22 | 556 |
| HSCIDTIPKSRCTAFQCKHSMAYRLSFCRKTCGTC | ShK-H1/A22 | 557 |
| QSCIDTIPKSRCTAFQCKHSMAYRLSFCRKTCGTC | ShK-Q1/A22 | 558 |
| PPRSCIDTIPKSRCTAFQCKHSMAYRLSFCRKTCGTC | PP-ShK-A22 | 559 |
| MRSCIDTIPKSRCTAFQCKHSMAYRLSFCRKTCGTC | M-ShK-A22 | 560 |
| GRSCIDTIPKSRCTAFQCKHSMAYRLSFCRKTCGTC | G-ShK-A22 | 561 |
| RSCIDTIPASRCTAFQCKHSMAYRLSFCRKTCGTC | ShK-A9/A22 | 884 |
| SCIDTIPASRCTAFQCKHSMAYRLSFCRKTCGTC | ShK-A9/A22 d1 | 885 |
| RSCIDTIPVSRCTAFQCKHSMKYRLSFCRKTCGTC | ShK-V9 | 886 |
| RSCIDTIPVSRCTAFQCKHSMAYRLSFCRKTCGTC | ShK-V9/A22 | 887 |
| SCIDTIPVSRCTAFQCKHSMKYRLSFCRKTCGTC | ShK-V9 d1 | 888 |
| SCIDTIPVSRCTAFQCKHSMAYRLSFCRKTCGTC | ShK-V9/A22 d1 | 889 |
| RSCIDTIPESRCTAFQCKHSMAYRLSFCRKTCGTC | ShK-E9/A22 | 890 |
| SCIDTIPESRCTAFQCKHSMAYRLSFCRKTCGTC | ShK-E9/A22 d1 | 891 |

TABLE 2-continued

ShK peptide and ShK peptide analog sequences

| Sequence/structure | Shorthand designation | SEQ ID NO: |
|---|---|---|
| RSCIDTIPKSACTAFQCKHSMAYRLSFCRKTCGTC | ShK-A11/A22 | 892 |
| SCIDTIPKSACTAFQCKHSMAYRLSFCRKTCGTC | ShK-A11/22 d1 | 893 |
| RSCIDTIPKSECTAFQCKHSMAYRLSFCRKTCGTC | ShK-E11/A22 | 894 |
| SCIDTIPKSECTAFQCKHSMAYRLSFCRKTCGTC | ShK-E11/A22 d1 | 895 |
| RSCIDTIPKSRCTDFQCKHSMKYRLSFCRKTCGTC | ShK-D14 | 896 |
| RSCIDTIPKSRCTDFQCKHSMAYRLSFCRKTCGTC | ShK-D14/A22 | 897 |
| SCIDTIPKSRCTDFQCKHSMKYRLSFCRKTCGTC | ShK-D14 d1 | 898 |
| SCIDTIPKSRCTDFQCKHSMAYRLSFCRKTCGTC | ShK-D14/A22 d1 | 899 |
| RSCIDTIPKSRCTAAQCKHSMAYRLSFCRKTCGTC | ShK-A15A/22 | 900 |
| SCIDTIPKSRCTAAQCKHSMAYRLSFCRKTCGTC | ShK-A15/A22 d1 | 901 |
| RSCIDTIPKSRCTAIQCKHSMKYRLSFCRKTCGTC | ShK-I15 | 902 |
| RSCIDTIPKSRCTAIQCKHSMAYRLSFCRKTCGTC | ShK-I15/A22 | 903 |
| SCIDTIPKSRCTAIQCKHSMKYRLSFCRKTCGTC | ShK-I15 d1 | 904 |
| SCIDTIPKSRCTAIQCKHSMAYRLSFCRKTCGTC | ShK-I15/A22 d1 | 905 |
| RSCIDTIPKSRCTAVQCKHSMKYRLSFCRKTCGTC | ShK-V15 | 906 |
| RSCIDTIPKSRCTAVQCKHSMAYRLSFCRKTCGTC | ShK-V15/A22 | 907 |
| SCIDTIPKSRCTAVQCKHSMKYRLSFCRKTCGTC | ShK-V15 d1 | 908 |
| SCIDTIPKSRCTAVQCKHSMAYRLSFCRKTCGTC | ShK-V15/A22 d1 | 909 |
| RSCIDTIPKSRCTAFRCKHSMKYRLSFCRKTCGTC | ShK-R16 | 910 |
| RSCIDTIPKSRCTAFRCKHSMAYRLSFCRKTCGTC | ShK-R16/A22 | 911 |
| SCIDTIPKSRCTAFRCKHSMKYRLSFCRKTCGTC | ShK-R16 d1 | 912 |
| SCIDTIPKSRCTAFRCKHSMAYRLSFCRKTCGTC | ShK-R16/A22 d1 | 913 |
| RSCIDTIPKSRCTAFKCKHSMKYRLSFCRKTCGTC | ShK-K16 | 914 |
| RSCIDTIPKSRCTAFKCKHSMAYRLSFCRKTCGTC | ShK-K16/A22 | 915 |
| SCIDTIPKSRCTAFKCKHSMKYRLSFCRKTCGTC | ShK-K16 d1 | 916 |
| SCIDTIPKSRCTAFKCKHSMAYRLSFCRKTCGTC | ShK-K16/A22 d1 | 917 |
| RSCIDTIPASECTAFQCKHSMKYRLSFCRKTCGTC | ShK-A9/E11 | 918 |
| RSCIDTIPASECTAFQCKHSMAYRLSFCRKTCGTC | ShK-A9/E11/A22 | 919 |
| SCIDTIPASECTAFQCKHSMKYRLSFCRKTCGTC | ShK-A9/E11 d1 | 920 |
| SCIDTIPASECTAFQCKHSMAYRLSFCRKTCGTC | ShK-A9/E11/A22 d1 | 921 |
| RSCIDTIPVSECTAFQCKHSMKYRLSFCRKTCGTC | ShK-V9/E11 | 922 |
| RSCIDTIPVSECTAFQCKHSMAYRLSFCRKTCGTC | ShK-V9/E11/A22 | 923 |
| SCIDTIPVSECTAFQCKHSMKYRLSFCRKTCGTC | ShK-V9/E11 d1 | 924 |
| SCIDTIPVSECTAFQCKHSMAYRLSFCRKTCGTC | ShK-V9/E11/A22 d1 | 925 |
| RSCIDTIPVSACTAFQCKHSMKYRLSFCRKTCGTC | ShK-V9/A11 | 926 |
| RSCIDTIPVSACTAFQCKHSMAYRLSFCRKTCGTC | ShK-V9/A11/A22 | 927 |
| SCIDTIPVSACTAFQCKHSMKYRLSFCRKTCGTC | ShK-V9/A11 d1 | 928 |

TABLE 2-continued

ShK peptide and ShK peptide analog sequences

| Sequence/structure | Shorthand designation | SEQ ID NO: |
|---|---|---|
| SCIDTIPVSACTAFQCKHSMAYRLSFCRKTCGTC | ShK-V9/A11/A22 d1 | 929 |
| RSCIDTIPASACTAFQCKHSMKYRLSFCRKTCGTC | ShK-A9/A11 | 930 |
| RSCIDTIPASACTAFQCKHSMAYRLSFCRKTCGTC | ShK-A9/A11/A22 | 931 |
| SCIDTIPASACTAFQCKHSMKYRLSFCRKTCGTC | ShK-A9/A11 d1 | 932 |
| SCIDTIPASACTAFQCKHSMAYRLSFCRKTCGTC | ShK-A9/A11/A22 d1 | 933 |
| RSCIDTIPKSECTDIRCKHSMKYRLSFCRKTCGTC | ShK-E11/D14/I15/R16 | 934 |
| RSCIDTIPKSECTDIRCKHSMAYRLSFCRKTCGTC | ShK-E11/D14/I15/R16/A22 | 935 |
| SCIDTIPKSECTDIRCKHSMKYRLSFCRKTCGTC | ShK-E11/D14/I15/R16 d1 | 936 |
| SCIDTIPKSECTDIRCKHSMAYRLSFCRKTCGTC | ShK-E11/D14/I15//R16 A22 d1 | 937 |
| RSCIDTIPVSECTDIRCKHSMKYRLSFCRKTCGTC | ShK-V9/E11/D14/I15/R16 | 938 |
| RSCIDTIPVSECTDIRCKHSMAYRLSFCRKTCGTC | ShK-V9/E11/D14/I15/R16/A22 | 939 |
| SCIDTIPVSECTDIRCKHSMKYRLSFCRKTCGTC | ShK-V9/E11/D14/I15/R16 d1 | 940 |
| SCIDTIPVSECTDIRCKHSMAYRLSFCRKTCGTC | ShK-V9/E11/D14/I15/R16/A22 d1 | 941 |
| RSCIDTIPVSECTDIQCKHSMKYRLSFCRKTCGTC | ShK-V9/E11/D14/I15 | 942 |
| RSCIDTIPVSECTDIQCKHSMAYRLSFCRKTCGTC | ShK-V9/E11/D14/I15/A22 | 943 |
| SCIDTIPVSECTDIQCKHSMKYRLSFCRKTCGTC | ShK-V9/E11/D14/I15 d1 | 944 |
| SCIDTIPVSECTDIQCKHSMAYRLSFCRKTCGTC | ShK-V9/E11/D14/I15/A22 d1 | 945 |
| RTCKDLIPVSECTDIRCKHSMKYRLSFCRKTCGTC | ShK-T2/K4/L6/V9/E11/D14/I15/R16 | 946 |
| RTCKDLIPVSECTDIRCKHSMAYRLSFCRKTCGTC | ShK-T2/K4/L6/V9/E11/D14/I15/R16/A22 | 947 |
| TCKDLIPVSECTDIRCKHSMKYRLSFCRKTCGTC | ShK-T2/K4/L6/V9/E11/D14/I15/R16 d1 | 948 |
| TCKDLIPVSECTDIRCKHSMAYRLSFCRKTCGTC | ShK-T2/K4/L6/V9/E11/D14/I15/R16/A22 d1 | 949 |

TABLE 2-continued

ShK peptide and ShK peptide analog sequences

| Sequence/structure | Short-hand designation | SEQ ID NO: |
|---|---|---|
| (L-Phosphotyrosine)-AEEARSCIDTIPKSRCTAFQCKHSMKYRLSFCRKTCGTC | ShK (L5) | 950 |
| QSCADTIPKSRCTAAQCKHSMKYRLSFCRKTCGTC | ShK Q1/A4/A15 | 1295 |
| QSCADTIPKSRCTAAQCKHSMAYRLSFCRKTCGTC | ShK Q1/A4/A15/A22 | 1296 |
| QSCADTIPKSRCTAAQCKHSM(Dap)YRLSFCRKTCGTC | ShK Q1/A4/A15/Dap2 2 | 1297 |
| QSCADTIPKSRCTAAQCKHSMKYRASFCRKTCGTC | ShK Q1/A4/A15/A25 | 1298 |
| QSCADTIPKSRCTAAQCKHSMAYRASFCRKTCGTC | ShK Q1/A4/A15/A22/A25 | 1299 |
| QSCADTIPKSRCTAAQCKHSM(Dap)YRASFCRKTCGTC | ShK Q1/A4/A15/Dap2 2/A25 | 1300 |

Many peptides as described in Table 2 can be prepared as described in U.S. Pat. No. 6,077,680 issued Jun. 20, 2000 to Kem et al., which is hereby incorporated by reference in its entirety. Other peptides of Table 2 can be prepared by techniques known in the art. For example, ShK(L5) (SEQ ID NO: 950) can be prepared as described in Beeton et al., Targeting effector memory T cells with a selective peptide inhibitor of Kv1.3 channels for therapy of autoimmune diseases, Molec. Pharmacol. 67(4): 1369-81 (2005), which is hereby incorporated by reference in its entirety. In Table 2 and throughout the specification, $X^{s15}$, $X^{s21}$, $X^{s22}$, $X^{s23}$ and $X^{s27}$ each independently refer to nonfunctional amino acid residues.

TABLE 3

HmK, BgK, AeK and AsKS peptide and peptide analog sequences

| Sequence/structure | Short-hand designation | SEQ ID NO: |
|---|---|---|
| RTCKDLIPVSECTDIRCRTSMKYRLNLCRKTCGSC | HmK | 6 |
| ATCKDLIPVSECTDIRCRTSMKYRLNLCRKTCGSC | HmK-A1 | 201 |
| STCKDLIPVSECTDIRCRTSMKYRLNLCRKTCGSC | HmK-S1 | 202 |
| TCKDLIPVSECTDIRCRTSMKYRLNLCRKTCGSC | HmK-d1 | 203 |
| SCKDLIPVSECTDIRCRTSMKYRLNLCRKTCGSC | HmK-d1/S2 | 204 |
| TCIDLIPVSECTDIRCRTSMKYRLNLCRKTCGSC | HmK-d1/I4 | 205 |
| TCKDTIPVSECTDIRCRTSMKYRLNLCRKTCGSC | HmK-d1/T6 | 206 |
| TCKDLIPKSECTDIRCRTSMKYRLNLCRKTCGSC | HmK-d1/K9 | 207 |
| TCKDLIPVSRCTDIRCRTSMKYRLNLCRKTCGSC | HmK-d1/R11 | 208 |
| TCKDLIPVSECTAIRCRTSMKYRLNLCRKTCGSC | HmK-d1/A14 | 209 |
| TCKDLIPVSECTDFRCRTSMKYRLNLCRKTCGSC | HmK-d1/F15 | 210 |
| TCKDLIPVSECTDIQCRTSMKYRLNLCRKTCGSC | HmK-d1/Q16 | 211 |
| TCKDLIPVSECTDIRCKTSMKYRLNLCRKTCGSC | HmK-d1/K18 | 212 |
| TCKDLIPVSECTDIRCRHSMKYRLNLCRKTCGSC | HmK-d1/H19 | 213 |
| TCKDLIPVSECTDIRCRTSMKYRLSLCRKTCGSC | HmK- | 214 |

TABLE 3-continued

HmK, BgK, AeK and AsKS peptide and peptide analog sequences

| Sequence/structure | Short-hand designation | SEQ ID NO: |
|---|---|---|
| | d1/S26 | |
| TCKDLIPVSECTDIRCRTSMKYRLNFCRKTCGSC | HmK-d1/F27 | 215 |
| TCKDLIPVSECTDIRCRTSMKYRLNLCRKTCGTC | HmK-d1/T34 | 216 |
| TCKDLIPVSRCTDIRCRTSMKYRLNFCRKTCGSC | HmK-d1/R11/F27 | 217 |
| ATCKDLIPVSRCTDIRCRTSMKYRLNFCRKTCGSC | HmK-A1/R11/F27 | 218 |
| TCIDTIPKSRCTAFQCKHSMKYRLSFCRKTCGSC | HmK-d1/Z1 | 219 |
| TCIDTIPKSRCTAFQCRTSMKYRLNFCRKTCGSC | HmK-d1/Z2 | 220 |
| TCADLIPASRCTAIACRTSMKYRLNFCRKTCGSC | HmK-d1/Z3 | 221 |
| TCADLIPASRCTAIACKHSMKYRLNFCRKTCGSC | HmK-d1/Z4 | 222 |
| TCADLIPASRCTAIACAHSMKYRLNFCRKTCGSC | HmK-d1/Z5 | 223 |
| RTCKDLIPVSECTDIRCRTSMX$^{h22}$YRLNLCRKTCGSC | HmK-X22 | 224 |
| ATCKDLX$^{h6}$PVSRCTDIRCRTSMKX$^{h22}$RLNX$^{h26}$CRKTCGSC | HmK-X6, 22, 26 | 225 |
| VCRDWFKETACRHAKSLGNCRTSQKYRANCAKTCELC | BgK | 9 |
| ACRDWFKETACRHAKSLGNCRTSQKYRANCAKTCELC | BgK-A1 | 226 |
| VCADWFKETACRHAKSLGNCRTSQKYRANCAKTCELC | BgK-A3 | 227 |
| VCRDAFKETACRHAKSLGNCRTSQKYRANCAKTCELC | BgK-A5 | 228 |
| VCRDWFKATACRHAKSLGNCRTSQKYRANCAKTCELC | BgK-A8 | 229 |
| VCRDWFKEAACRHAKSLGNCRTSQKYRANCAKTCELC | BgK-A9 | 230 |
| VCRDWFKETACAHAKSLGNCRTSQKYRANCAKTCELC | BgK-A12 | 231 |
| VCRDWFKETACRHAASLGNCRTSQKYRANCAKTCELC | BgK-A15 | 232 |
| VCRDWFKETACRHAKALGNCRTSQKYRANCAKTCELC | BgK-A16 | 233 |
| VCRDWFKETACRHAKSAGNCRTSQKYRANCAKTCELC | BgK-A17 | 234 |
| VCRDWFKETACRHAKSLGNCATSQKYRANCAKTCELC | BgK-A21 | 235 |
| VCRDWFKETACRHAKSLGNCRASQKYRANCAKTCELC | BgK-A22 | 236 |
| VCRDWFKETACRHAKSLGNCRTSQKYAANCAKTCELC | BgK-A27 | 237 |
| VCRDWFKETACRHAKSLGNCRTSQKYRANCAATCELC | BgK-A32 | 238 |
| VCRDWFKETACRHAKSLGNCRTSQKYRANCAKACELC | BgK-A33 | 239 |
| VCRDWFKETACRHAKSLGNCRTSQKYRANCAKTCALC | BgK-A35 | 240 |
| VCRDWFKETACRHAKSLGNCRTSQKYRANCAKTCEAC | BgK-A37 | 241 |
| GCKDNFSANTCKHVKANNNCGSQKYATNCAKTCGKC | AeK | 7 |
| ACKDNFAAATCKHVKENKNCGSQKYATNCAKTCGKC | AsKS | 8 |

In Table 3 and throughout the specification, $X^{h6}$, $X^{h22}$, $X^{h26}$ are each independently nonfunctional residues.

TABLE 4

MgTx peptide and MgTx peptide analog sequences

| Sequence/structure | Shorthand designation | SEQ ID NO: |
|---|---|---|
| TIINVKCTSPKQCLPPCKAQFGQSAGAKCMNGKCKCYPH | MgTx | 28 |
| TIINVACTSPKQCLPPCKAQFGQSAGAKCMNGKCKCYPH | MgTx-A6 | 242 |
| TIINVSCTSPKQCLPPCKAQFGQSAGAKCMNGKCKCYPH | MgTx-S6 | 243 |
| TIINVKCTSPAQCLPPCKAQEGQSAGAKCMNGKCKCYPH | MgTx-A11 | 244 |
| TIINVKCTSPKQCLPPCAAQFGQSAGAKCMNGKCKCYPH | MgTx-A18 | 245 |
| TIINVKCTSPKQCLPPCKAQFGQSAGAACMNGKCKCYPH | MgTx-A28 | 246 |
| TIINVKCTSPKQCLPPCKAQFGQSAGAKCMNGACKCYPH | MgTx-A33 | 247 |
| TIINVKCTSPKQCLPPCKAQFGQSAGAKCMNGKCACYPH | MgTx-A35 | 248 |
| TIINVKCTSPKQCLPPCKAQFGQSAGAKCMNGKCKCYPN | MgTx-H39N | 249 |
| TIINVACTSPKQCLPPCKAQFGQSAGAKCMNGKCKCYPN | MgTx-A6/H39N | 250 |
| TIINVSCTSPKQCLPPCKAQFGQSAGAKCMNGKCKCYS | MgTx-S6/38/d39 | 251 |
| TIITISCTSPKQCLPPCKAQFGQSAGAKCMNGKCKCYPH | MgTx-T4/I5/S6 | 252 |
| TISCTSPKQCLPPCKAQFGQSAGAKCMNGKCKCYPH | MgTx-d3/T4/I5/S6 | 253 |
| TISCTSPKQCLPPCKAQFGQSAGAKCMNGKGKCFGR | MgTx-Pi2 | 254 |
| NVACTSPKQCLPPCKAQFGQSAGAKCMNGKCKCYPH | MgTx-d3/A6 | 255 |
| QFTNVSCTSPKQCLPPCKAQFGQSAGAKCMNGKCKCYS | MgTx-ChTx | 256 |
| QFTDVDCTSPKQCLPPCKAQFGQSAGAKCMNGKCKCYQ | MgTx-IbTx | 257 |
| IINVSCTSPKQCLPPCKAQFGQSAGAKCMNGKCKCYPH | MgTx-Z1 | 258 |
| IITISCTSPKQCLPPCKAQFGQSAGAKCMNGKCKCYPH | MgTx-Z2 | 259 |
| GVIINVSCTSPKQCLPPCKAQEGQSAGAKCMNGKCKGYPH | MgTx-Z3 | 260 |

Many peptides as described in Table 4 can be prepared as described in WO 95/03065, published Feb. 2, 1995, for which the applicant is Merck & Co., Inc. That application corresponds to U.S. Ser. No. 07/096,942, filed 22 Jul. 1993, which is hereby incorporated by reference in its entirety.

TABLE 5

AgTx2 peptide and AgTx2 peptide analog sequences

| Sequence/structure | Shorthand designation | SEQ ID NO: |
|---|---|---|
| GVPINVSCTGSPQCIKPCKDAGMRFGKCMNRKCHCTPK | AgTx2 | 23 |
| GVPIAVSCTGSPQCIKPCKDAGMRFGKCMNRKCHCTPK | AgTx2-A5 | 261 |
| GVPINVSCTGSPQCIAPCKDAGMRFGKCMNRKCHCTPK | AgTx2-A16 | 262 |
| GVPINVSCTGSPQCIKPCADAGMRFGKCMNRKCHCTPK | AgTx2-A19 | 263 |
| GVPINVSCTGSPQCIKPCKDAGMAFGKCMNRKCHCTPK | AgTx2-A24 | 264 |
| GVPINVSCTGSPQCIKPCKDAGMRFGACMNRKCHCTPK | AgTx2-A27 | 265 |
| GVPINVSCTGSPQCIKPCKDAGMRFGKCMNAKCHCTPK | AgTx2-A31 | 266 |
| GVPINVSCTGSPQCIKPCKDAGMRFGKCMNRACHCTPK | AgTx2-A32 | 267 |
| GVPINVSCTGSPQCIKPCKDAGMRFGKCMNRKCHCTPA | AgTx2-A38 | 268 |
| GVPIAVSCTGSPQCIKPCKDAGMRFGKCMNRKCHCTPA | AgTx2-A5/A38 | 269 |
| GVPINVSCTGSPQCIKPCKDAGMRFGKCMNGKCHCTPK | AgTx2-G31 | 270 |
| GVPIIVSCKGSRQCIKPCKDAGMRFGKCMNGKCHCTPK | AgTx2-OSK_z1 | 271 |
| GVPIIVSCKISRQCIKPCKDAGMRFGKCMNGKCHCTPK | AgTx2-OSK_z2 | 272 |
| GVPIIVKCKGSRQCIKPCKDAGMRFGKCMNGKCHCTPK | AgTx2-OSK_z3 | 273 |
| GVPIIVKCKISRQCIKPCKDAGMRFGKCMNGKCHCTPK | AgTx2-OSK_z4 | 274 |
| GVPIIVKCKISRQCIKPCKDAGMRFGKCMNGKCHCTPK | AgTx2-OSK_z5 | 275 |

TABLE 6

Heteromitrus spinnifer (HsTx1) peptide and HsTx1 peptide analog sequences

| Sequence/structure | Shorthand designation | SEQ ID NO: |
|---|---|---|
| ASCRTPKDCADPCRKETGCPYGKCMNRKCKCNRC | HsTx1 | 61 |
| ASCXTPKDCADPCRKETGCPYGKCMNRKCKCNRC | HsTx1-X4 | 276 |
| ASCATPKDCADPCRKETGCPYGKCMNRKCKCNRC | HsTx1-A4 | 277 |
| ASCRTPXDCADPCRKETGCPYGKCMNRKCKCNRC | HsTx1-X7 | 278 |
| ASCRTPADCADPCRKETGCPYGKCMNRKCKCNRC | HsTx1-A7 | 279 |
| ASCRTPKDCADPCXKETGCPYGKCMNRKCKCNRC | HsTx1-X14 | 280 |

TABLE 6-continued

Heteromitrus spinnifer (HsTx1) peptide and HsTx1 peptide analog sequences

| Sequence/structure | Short-hand designation | SEQ ID NO: |
|---|---|---|
| ASCRTPKDCADPCAKETGCPYGKCMNRKCKCNRC | HsTx1-A14 | 281 |
| ASCRTPKDCADPCRXETGCPYGKCMNRKCKCNRC | HsTx1-X15 | 282 |
| ASCRTPKDCADPCRAETGCPYGKCMNRKCKCNRC | HsTx1-A15 | 283 |
| ASCRTPKDCADPCRKETGCPYGXGMNRKCKCNRC | HsTx1-X23 | 284 |
| ASCRTPKDCADPCRKETGCPYGACMNRKCKCNRC | HsTx1-A23 | 285 |
| ASCRTPKDCADPCRKETGCPYGKCMNXKCKCNRC | HsTx1-X27 | 286 |
| ASCRTPKDCADPCRKETGCPYGKCMNAKCKCNRC | HsTx1-A27 | 287 |
| ASCRTPKDCADPCRKETGCPYGKCMNRXCKCNRC | HsTx1-X28 | 288 |
| ASCRTPKDCADPCRKETGCPYGKCMNRACKCNRC | HsTx1-A28 | 289 |
| ASCRTPKDCADPCRKETGCPYGKCMNRKCXCNRC | HsTx1-X30 | 290 |
| ASCRTPKDCADPCRKETGCPYGKCMNRKCACNRC | HsTx1-A30 | 291 |
| ASCRTPKDCADPCRKETGCPYGKCMNRKCKCNXC | HsTx1-X33 | 292 |
| ASCRTPKDCADPCRKETGCPYGKCMNRKCKCNAC | HsTx2-A33 | 293 |

Peptides as described in Table 5 can be prepared as described in U.S. Pat. No. 6,689,749, issued Feb. 10, 2004 to Lebrun et al., which is hereby incorporated by reference in its entirety.

TABLE 7

Orthochirus scrobiculosus (OSK1) peptide and OSK1 peptide analog sequences

| Sequence/structure | Short-hand designation | SEQ ID NO: |
|---|---|---|
| GVIINVKCKISRQCLEPCKKAGMRFGKCMNGKCHCTPK | OSK1 | 25 |
| GVIINVSCKISRQCLEPCKKAGMRFGKCMNGKCHCTPK | OSK1-S7 | 1303 |
| GVIINVKCKISRQCLKPCKKAGMRFGKCMNGKCHCTPK | OSK1-K16 | 294 |
| GVIINVKCKISRQCLEPCKDAGMRFGKCMNGKCHCTPK | OSK1-D20 | 295 |
| GVIINVKCKISRQCLKPCKDAGMRFGKCMNGKCHCTPK | OSK1-K16, D20 | 296 |
| GVIINVSCKISRQCLKPCKDAGMRFGKCMNGKCHCTPK | OSK1-S7, K16, D20 | 1308 |
| GVIINVKCKISPQCLKPCKDAGMRFGKCMNGKCHCTPK | OSK1-P12, K16, D20 | 297 |
| GVIINVKCKISRQCLKPCKDAGMRFGKCMNGKCHCYPK | OSK1-K16, D20, Y36 | 298 |
| Ac-GVIINVKCKISPQCLKPCKDAGMRFGKCMNGKCHCTPK | Ac-OSK1-P12, K16, D20 | 562 |
| GVIINVKCKISPQCLKPCKDAGMRFGKCMNGKCHCTPK-NH$_2$ | OSK1-P12, K16, D20-NH$_2$ | 563 |
| AC-GVIINVKCKISPQCLKPCKDACMRFGKCMNGKCHCTPK-NH$_2$ | Ac-OSK1-P12, K16, D20-NH$_2$ | 564 |
| GVIINVKCKISRQCLKPCKDAGMRFGKCMNGKCHCYPK-NH$_2$ | OSK1-K16, D20, Y36-NH$_2$ | 565 |
| Ac-GVIINVKCKISRQCLKPCKDAGMRFGKCMNGKCHCYPK | Ac-OSK1-K16, D20, Y36 | 566 |
| Ac-GVIINVKCKISRQCLKPCKDAGMRFGKCMNGKCHCYPK-NH$_2$ | Ac-OSK1-K16, D20, Y36-NH$_2$ | 567 |
| GVIINVKCKISRQCLKPCKKAGMRFGKCMNGKCHCTPK-NH$_2$ | OSK1-K16-NH$_2$ | 568 |
| Ac-GVIINVKCKISRQCLKPCKKAGMRFGKCMNGKCHCTPK | Ac-OSK1-K16 | 569 |
| Ac-GVIINVKCKISRQCLKPCKKAGMRFGKCMNGKCHCTPK-NH$_2$ | Ac-OSK1-K16-NH$_2$ | 570 |
| Ac-GVIINVKCKISRQCLEPCKDAGMRFGKCMNGKCHCTPK | Ac-OSK1-D20 | 571 |

TABLE 7-continued

Orthochirus scrobiculosus (OSK1) peptide and OSK1 peptide analog sequences

| Sequence/structure | Short-hand designation | SEQ ID NO: |
|---|---|---|
| GVIINVKCKISRQCLEPCKDAGMRFGKCMNGKCHCTPK-NH$_2$ | OSK1-D20-NH$_2$ | 572 |
| Ac-GVIINVKCKISRQCLEPCKDAGMRFGKCMNGKCHCTPK-NH$_2$ | Ac-OSK1-D20-NH$_2$ | 573 |
| GVIINVKCKISRQCLEPCKKAGMRFCKCMNGKCHCTPK-NH$_2$ | OSK1-NH$_2$ | 574 |
| Ac-GVIINVKCKISRQCLEPGKKAGMRFGKCMNGKCHCTPK | Ac-OSK1 | 575 |
| Ac-GVIINVKCKISRQCLEPCKKAGMRFGKCMNGKCHCTPK-NH$_2$ | Ac-OSK1-NH$_2$ | 576 |
| GVIINVKCKISRQCLKPCKDAGMRFGKCMNGKCHCTPK-NH$_2$ | OSK1-K16, D20-NH$_2$ | 577 |
| Ac-GVIINVKCKISRQCLKPCKDAGMRFGKCMNGKCHCTPK | Ac-OSK1-K16, D20 | 578 |
| Ac-GVIINVKCKISRQCLKPCKDAGMRFGKCMNGKCHCTPK-NH$_2$ | Ac-OSK1-K16, D20-NH$_2$ | 579 |
| VIINVKCKISRQCLEPCKKAGMRFGKCMNGKCHCTPK | Δ1-OSK1 | 580 |
| Ac-VIINVKCKISRQCLEPCKKAGMRFGKCMNGKCHCTPK | Ac-Δ1-OSK1 | 581 |
| VIINVKCKISRQCLEPCKKAGMRFGKCMNGKCHCTPK-NH$_2$ | Δ1-OSK1-NH$_2$ | 582 |
| Ac-VIINVKCKISRQCLEPCKKAGMRFGKCMNGKCHCTPK-NH$_2$ | Ac-Δ1-OSK1-NH$_2$ | 583 |
| GVIINVKCKISRQCLEPCKKAGMRFGKCMNGKCACTPK | OSK1-A34 | 584 |
| Ac-GVIINVKCKISRQCLEPCKKAGMRFGKCMNGKCACTPK | Ac-OSK1-A34 | 585 |
| GVIINVKCKISRQCLEPCKKAGMRFGKCMNGKCACTPK-NH$_2$ | OSK1-A34-NH$_2$ | 586 |
| AC-GVIINVKCKISRQCLEPCKKAGMRFGKCMNGKCACTPKNH$_2$ | AC-OSK1-A34-NH$_2$ | 587 |
| VIINVKCKISRQCLKPCKDAGMRFGKCMNGKCHCTPK | Δ1-OSK1-K16, D20 | 588 |
| Ac-VIINVKCKISRQCLKPCKDAGMRFGKCMNGKCHCTPK | Ac-Δ1-OSK1-K16, D20 | 589 |
| VIINVKCKISRQCLKPCKDAGMRFGKCMNGKCHCTPK-NH$_2$ | Δ1-OSK1-K16, D20-NH$_2$ | 590 |
| Ac-VIINVKCKISRQCLKPCKDAGMRFGKCMNGKCHCTPK-NH$_2$ | Ac-Δ1-OSK1-K16, D20-NH$_2$ | 591 |
| NVKCKISRQCLKPCKDAGMRFGKCMNGKCHCTPK | (Δ1-4)-OSK1-K16, D20 | 592 |
| Ac-NVKCKISRQCLKPCKDAGMRFGKCMNGKCHCTPK | Ac-(Δ1-4)-OSK1-K16, D20 | 593 |
| NVKCKISRQCLKPCKDAGMRFGKCMNGKCHCTPK-NH$_2$ | (Δ1-4)-OSK1-K16, D20-NH$_2$ | 594 |
| Ac-NVKCKISRQCLKPCKDAGMRFGKCMNGKCHCTPK-NH$_2$ | Ac-(Δ1-4)-OSK1-K16, D20-NH$_2$ | 595 |
| KCKISRQCLKPCKDAGMRFGKCMNGKCHCTPK | (Δ1-6)-OSK1-K16, D20 | 596 |
| Ac-KCKISRQCLKPCKDAGMRFGKCMNGKCHCTPK | Ac-(Δ1-6)-OSK1-K16, D20 | 597 |
| KCKISRQCLKPCKDAGMRFGKCMNGKCHCTPK-NH$_2$ | (Δ1-6)-OSK1-K16, D20-NH$_2$ | 598 |
| Ac-KCKISRQCLKPCKDAGMRFGKCMNGKCHCTPK-NH$_2$ | Ac-(Δ1-6)-OSK1-K16, D20-NH$_2$ | 599 |
| CKISRQCLKPCKDAGMRFGKCMNGKCHCTPK | (Δ1-7)-OSK1-K16, D20 | 600 |

TABLE 7-continued

Orthochirus scrobiculosus (OSK1) peptide and OSK1 peptide analog sequences

| Sequence/structure | Short-hand designation | SEQ ID NO: |
|---|---|---|
| Ac-CKISRQCLKPCKDAGMRFGKCMNGKCHCTPK | Ac-(Δ1-7)-OSK1-K16, D20 | 601 |
| CKISRQCLKPCKDAGMRFGKCMNGKCHCTPK-NH$_2$ | (Δ1-7)-OSK1-K16, D20-NH$_2$ | 602 |
| Ac-CKISRQCLKPCKDAGMRFGKCMNGKCHCTPK-NH$_2$ | Ac-(Δ1-7)-OSK1-K16, D20-NH$_2$ | 603 |
| GVIINVKCKISRQCLKPCKDAGMRNGKCMNGKCHCTPK | OSK1-K16, D20, N25 | 604 |
| GVIINVKCKISRQCLKPCKDAGMRNGKCMNGKCHCTPK-NH$_2$ | OSK1-K16, D20, N25-NH$_2$ | 605 |
| Ac-GVIINVKCKISRQCLKPCKDAGMRNGKCMNGKCHCTPK | Ac-OSK1-K16, D20, N25 | 606 |
| Ac-GVIINVKCKISRQCLKPCKDAGMRNGKCMNGKCHCTPK-NH$_2$ | Ac-OSK1-K16, D20, N25-NH$_2$ | 607 |
| GVIINVKCKISRQCLKPCKDAGMRFGKCMNRKCHCTPK | OSK1-K16, D20, R31 | 608 |
| GVIINVKCKISRQCLKPCKDAGMRFGKCMNRKCHGTPK-NH$_2$ | OSK1-K16, D20, R31-NH$_2$ | 609 |
| Ac-GVIINVKCKISRQCLKPCKDAGMRFGKCMNRKCHCTPK | Ac-OSK1-K16, D20, R31 | 610 |
| Ac-GVIINVKCKISRQCLKPCKDAGMRFGKCMNRKCHCTPK-NH$_2$ | Ac-OSK1-K16, D20, R31-NH$_2$ | 611 |
| GVINVKCKISKQCLKPCRDAGMRFGKCMNGKCHCTPK | OSK1-K12, K16, R19, D20 | 612 |
| Ac-GVIINVKCKISKQCLKPCRDAGMRFGKCMNGKCHCTPK | Ac-OSK1-K12, K16, R19, D20 | 613 |
| GVIINVKCKISKQCLKPCRDAGMRFGKCMNGKCHCTPK-NH$_2$ | OSK1-K12, K16, R19, D20-NH$_2$ | 614 |
| Ac-GVIINVKCKISKQCLKPCRDAGMRFGKCMNGKCHCTPK-NH$_2$ | Ac-OSK1-K12, K16, R19, D20-NH$_2$ | 615 |
| TIINVKCKISRQCLKPCKDAGMRFGKCMNGKCHCTPK | Δ1-OSK1-T2, K16, D20 | 616 |
| Ac-TIINVKCKISRQCLKPCKDAGMRFGKCMNGKCHCTPK | Ac-Δ1-OSK1-T2, K16, D20 | 617 |
| TIINVKCKISRQCLKPCKDAGMRFGKCMNGKCHCTPK-NH$_2$ | Δ1-OSK1-T2, K16, D20-NH$_2$ | 618 |
| Ac-TIINVKCKISRQCLKPCKDAGMRFGKCMNGKCHCTPK-NH$_2$ | Ac-Δ1-OSK1-T2, K16, D20-NH$_2$ | 619 |
| GVKINVKCKISRQCLEPCKKAGMRFGKCMNGKCHCTPK | OSK1-K3 | 620 |
| Ac-GVKINVKCKISRQCLEPCKKAGMRFGKCMNGKCHCTPK | Ac-OSK1-K3 | 621 |
| GVKINVKCKISRQCLEPCKKAGMRFGKCMNGKCHCTPK-NH$_2$ | OSK1-K3-NH$_2$ | 622 |
| Ac-GVKINVKCKISRQCLEPCKKAGMRFGKCMNGKCHCTPK-NH$_2$ | Ac-OSK1-K3-NH$_2$ | 623 |
| GVKINVKCKISRQCLEPCKKAGMRFGKCMNGKCACTPK | OSK1-K3, A34 | 624 |
| GVKINVKCKISRQCLKPCKDAGMRFGKCMNGKCHCTPK | OSK1-K3, K16, D20 | 625 |
| GVKINVKCKISRQCLKPCKDAGMRFGKCMNGKCACTPK | OSK1-K3, K16, D20, A34 | 626 |

TABLE 7-continued

Orthochirus scrobiculosus (OSK1) peptide and OSK1 peptide analog sequences

| Sequence/structure | Short-hand designation | SEQ ID NO: |
|---|---|---|
| Ac-GVKINVKCKISRQCLEPCKKAGMRFGKCMNGKCACTPK | Ac-OSK1-K3, A34 | 627 |
| GVKINVKCKISRQCLEPCKKAGMRFGKCMNGKCACTPK-NH$_2$ | OSK1-K3, A34-NH$_2$ | 628 |
| Ac-GVKINVKCKISRQCLEPCKKAGMRFGKCMNGKCACTPK-NH$_2$ | Ac-OSK1-K3, A34-NH$_2$ | 629 |
| Ac-GVKINVKCKISRQCLKPCKDAGMRFGKCMNGKCACTPK | Ac-OSK1-K3, K16, D20, A34 | 630 |
| GVKINVKCKISRQCLKPCKDAGMRFGKCMNGKCACTPK-NH$_2$ | OSK1-K3, K16, D20, A34-NH$_2$ | 631 |
| Ac-GVKINVKCKISRQCLKPCKDAGMRFGKCMNGKCACTPK-NH$_2$ | Ac-OSK1-K3, K16, D20, A34-NH$_2$ | 632 |
| Ac-GVKINVKCKISRQCLKPCKDAGMRFGKCMNGKCHCTPK | Ac-OSK1-K3, K16, D20 | 633 |
| GVKINVKCKISRQCLKPCKDAGMRFGKCMNGKCHCTPK-NH$_2$ | OSK1-K3, K16, D20-NH$_2$ | 634 |
| Ac-GVKINVKCKISRQCLKPCKDAGMRFGKCMNGKCHCTPK-NH$_2$ | Ac-OSK1-K3, K16, D20-NH$_2$ | 635 |
| GVIINVKCKISRQCLKPCKDAGMRFGKCMNGKCHCT | Δ36-38-OSK1-K16, D20 | 636 |
| GVIINVKCKISRQCLOPCKDAGMRFGKCMNGKCHCTPK | OSK1-O16, D20 | 980 |
| GVIINVKCKISRQCL[hLys]PCKDAGMRFGKCMNGKGHCTPK | OSK1-hLys 16, D20 | 981 |
| GVIINVKCKISRQCL[hArg]PCKDAGMRFGKCMNGKCHCTPK | OSK1-hArg 16, D20 | 982 |
| GVIINVKCKISRQCL[Cit]PCKDAGMRFGKCMNGKCHCTPK | OSK1-Cit 16, D20 | 983 |
| GVIINVKCKISRQCL[hCit]PCKDAGMRFGKCMNGKCHCTPK | OSK1-hCit 16, D20 | 984 |
| GVIINVKCKISRQCL[Dpr]PCKDAGMRFGKCMNGKCHCTPK | OSK1-Dpr 16, D20 | 985 |
| GVIINVKCKISRQCL[Dab]PCKDACMRFGKCMNGKCHCTPK | OSK1-Dab 16, D20 | 986 |
| GVIINVKCKISRQCLOPCKDAGMRFGKCMNGKCHCYPK | OSK1-O16, D20, Y36 | 987 |
| GVIINVKCKISRQCL[hLys]PCKDAGMRFGKCMNGKCHCYPK | OSK1-hLys 16, D20, Y36 | 988 |
| GVIINVKCKISRQCL[hArg]PCKDAGMRFGKCMNGKCHCYPK | OSK1-hArg 16, D20, Y36 | 989 |
| GVIINVKCKISRQCL[Cit]PCKDAGMRFGKCMNGKCHCYPK | OSK1-Cit 16, D20, Y36 | 990 |
| GVIINVKCKISRQCL[hCit]PCKDAGMRFGKCMNGKCHCYPK | OSK1-hCit 16, D20, Y36 | 991 |
| GVIINVKCKISRQCL[Dpr]PCKDAGMRFGKCMNGKCHCYPK | OSK1-Dpr 16, D20, Y36 | 992 |
| GVIINVKCKISRQCL[Dab]PCKDAGMRFGKCMNGKCHCYPK | OSK1-Dab 16, D20, Y36 | 993 |
| GVIINVKCKISRQCLKPCKDAGMRFGKCMNGKCACYPK | OSK1-K16, D20, A34, Y36 | 994 |
| GVIINVKCKISRQCLKPCKDAGMRFGKCMNGKCGCYPK | OSK1-K16, D20, G34, Y36 | 995 |

TABLE 7-continued

Orthochirus scrobiculosus (OSK1) peptide and OSK1 peptide analog sequences

| Sequence/structure | Short-hand designation | SEQ ID NO: |
|---|---|---|
| GVIINVKCKISRQCLKPCKDAGMRFGKCMNGKCACFPK | OSK1-K16, D20, A34, F36 | 996 |
| GVIINVKCKISRQCLKPCKDAGMRFGKCMNGKCACWPK | OSK1-K16, D20, A34, W36 | 997 |
| GVIINVKCKISRQCLKPCKEAGMRFGKCMNGKCACYPK | OSK1-K16, E20, A34, Y36 | 998 |
| GVIINVKCKISRQCLOPCKDAGMRFGKCMNGKCACTPK | OSK1-O16, D20, A34 | 999 |
| GVIINVKCKISRQCL[hLys]PCKDAGMRFGKCMNGKCACTPK | OSK1-hLys 16, D20, A34 | 1000 |
| GVIINVKCKISRQCL[hArg]PCKDAGMRFGKCMNGKCACTPK | OSK1-hArg 16, D20, A34 | 1001 |
| GVIINVKCKISRQCL[Cit]PCKDAGMRFGKCMNGKCACTPK | OSK1-Cit 16, D20, A34 | 1002 |
| GVIINVKCKISRQCL[hCit]PCKDAGMRFGKCMNGKCHCTPK | OSK1-hCit 16, D20, A34 | 1003 |
| GVIINVKCKISRQCL[Dpr]PCKDAGMRFGKCMNGKCACTPK | OSK1-Dpr 16, D20, A34 | 1004 |
| GVIINVKCKISRQCL[Dab]PCKDAGMRFGKCMNGKCACTPK | OSK1-Dab 16, D20, A34 | 1005 |
| GVIINVKCKISRQCLOPCKDAGMRFGKCMNGKCHC | Δ36-38, OSK1-O16, D20, | 1006 |
| GVIINVKCKISRQCL[hLys]PCKDAGMRFGKCMNGKCHC | Δ36-38, OSK1-hLys 16, D20 | 1007 |
| GVIINVKCKISRQCL[hArg]PCKDAGMRFGKCMNGKCHC | Δ36-38, OSK1-hArg 16, D20 | 1008 |
| GVIINVKCKISRQCL[Cit]PCKDAGMRFGKCMNGKCHC | Δ36-38, OSK1-Cit 16, D20 | 1009 |
| GVIINVKCKISRQCL[hCit]PCKDAGMRFGKCMNGKCHC | Δ36-38, OSK1-hCit 16, D20 | 1010 |
| GVIINVKCKISRQCL[Dpr]PCKDAGMRFGKCMNGKCHC | Δ36-38, OSK1-Dpr 16, D20 | 1011 |
| GVIINVKCKTSRQCL[Dab]PCKDAGMRFGKCMNGKCHC | Δ36-38, OSK1-Dab16, D20 | 1012 |
| GVIINVKCKISRQCLOPCKDAGMRFGKCMNGKCAC | Δ36-38, OSK1-O16, D20, A34 | 1013 |
| GVIINVKCKISRQCL[hLys]PCKDAGMRFGKCMNGKCAC | Δ36-38, OSK1-hLys 16, D20, A34 | 1014 |
| GVIINVKCKISRQCL[hArg]PCKDAGMRFGKCMNGKCAC | Δ36-38, OSK1-hArg 16, D20, A34 | 1015 |
| GVIINVKCKISRQCL[Cit]PCKDAGMRFGKCMNGKCAC | Δ36-38, OSK1-Cit 16, D20, A34 | 1016 |
| GVIINVKCKISRQCL[hCit]PCKDAGMRFGKCMNGKCHC | Δ36-38, OSK1-hCit 16, D20, A34 | 1017 |
| GVIINVKCKISRQCL[Dpr]PCKDAGMRFGKCMNGKCAC | Δ36-38, OSK1-Dpr 16, D20, A34 | 1018 |
| GVIINVKCKISRQCL[Dab]PCKDAGMRFCKCMNGKCAC | Δ36-38, OSK1-Dab 16, D20, A34 | 1019 |

TABLE 7-continued

Orthochirus scrobiculosus (OSK1) peptide and OSK1 peptide analog sequences

| Sequence/structure | Short-hand designation | SEQ ID NO: |
| --- | --- | --- |
| GVIINVKCKISRQCLKPCKDAGMRFGKCMNGKCGCYGG | OSK1-K16, D20, G34, Y36, G37, G38 | 1020 |
| GVIINVKCKISRQCLOPCKDAGMRFGKCMNGKCHCYGG | OSK1-O16, D20, Y36, G37, G38 | 1021 |
| GVIINVKCKISRQCL[hLys]PCKDAGMRFGKCMNGKCHCYGG | OSK1-hLys 16, D20, Y36, G37, G38 | 1022 |
| GVIINVKCKISRQCL[hArg]PCKDAGMRFGKCMNGKCHCYGG | OSK1-hArg 16, D20, Y36, G37, G38 | 1023 |
| GVIINVKCKISRQCL[Cit]PCKDAGMRFGKCMNGKCHCYGG | OSK1-Cit 16, D20, Y36, G37, G38 | 1024 |
| GVIINVKCKISRQCL[hCit]PCKDAGMRFGKCMNGKCHCYGG | OSK1-hCit 16, D20, Y36, G37, G38 | 1025 |
| GVIINVKCKISRQCL[Dpr]PCKDAGMRFGKCMNGKCHCYGG | OSK1-Dpr 16, D20, Y36, G37, G38 | 1026 |
| GVIINVKCKISRQCLKPCKDAGMRFGKCMNGKCACYGG | OSK1-K16, D20, A34, Y36, G37, G38 | 1027 |
| GVIINVKCKISRQCLOPCKDAGMRFGKCMNGKCACYGG | OSK1-O16, D20, A34, Y36, G37, G38 | 1028 |
| GVIINVKCKISRQCL[hLys]PCKDAGMRFGKCMNGKCACYGG | OSK1-hLys 16, D20, A34, Y36, G37, G38 | 1029 |
| GVIINVKCKISRQCL[hArg]PCKDAGMRFGKCMNGKCACYGG | OSK1-hArg 16, D20, A34, Y36, G37, G38 | 1030 |
| GVIINVKCKISRQCL[Cit]PCKDAGMRFGKCMNGKCACYGG | OSK1-Cit 16, D20, A34, Y36, G37, G38 | 1031 |
| GVIINVKCKISRQCL[hCit]PCKDAGMRFGKCMNGKCHCYGG | OSK1-hCit 16, D20, A34, Y3, G37, G38 | 1032 |
| GVIINVKCKISRQCL[Dpr]PCKDAGMRFGKCMNGKCACYGG | OSK1-Dpr 16, D20, A34, Y36, G37, G38 | 1033 |
| GVIINVKCKISRQCL[Dab]PCKDAGMREGKCMNGKCACYGG | OSK1-Dab 16, D20, A34, Y36, G37, G38 | 1034 |
| GVIINVKCKISRQCLKPCKDAGMRFGKCMNGKCACYG | Δ38, OSK1-K16, D20, A34, Y36, G37 | 1035 |
| GVIINVKCKISRQCLOPCKDAGMRFGKCMNGKCHCGGG | OSK1-O16, D20, G36-38 | 1036 |
| GVIINVKCKISRQCL[hLys]PCKDAGMRFGKCMNGKCHCGGG | OSK1-hLys 16, D20, G36-38 | 1037 |
| GVIINVKCKISRQCL[hArg]PCKDAGMRFGKCMNGKCHCGGG | OSK1-hArg 16, D20, G36-38 | 1038 |

TABLE 7-continued

Orthochirus scrobiculosus (OSK1) peptide and OSK1 peptide analog sequences

| Sequence/structure | Short-hand designation | SEQ ID NO: |
|---|---|---|
| GVIINVKCKISRQCL[Cit]PCKDAGMRFGKCMNGKCHCGGG | OSK1-Cit 16, D20, G36-38 | 1039 |
| GVIINVKCKISRQCL[hCit]PCKDAGMRFGKCMNGKCHCGGG | OSK1-hCit 16, D20, G36-38 | 1040 |
| GVIINVKCKISRQCL[Dpr]PCKDAGMRFGKCMNGKCHCGGG | OSK1-Dpr 16, D20, G36-38 | 1041 |
| GVIINVKCKISRQCLKPCKDAGMRFGKCMNGKCACFGG | OSK1-K16, D20, A34, F36, G37, G38 | 1042 |
| GVIINVKCKISRQCLOPCKDAGMRFGKCMNGKCACGGG | OSK1-O16, D20, A34, G36-38 | 1043 |
| GVIINVKCKISRQCL[hLys]PCKDAGMRFGKCMNGKCACGGG | OSK1-hLys 16, D20, A34, G36-38 | 1044 |
| GVIINVKCKISRQCL[hArg]PCKDAGMRFGKCMNGKCACGGG | OSK1-hArg 16, D20, A34, G36-38 | 1045 |
| GVIINVKCKISRQCL[Cit]PCKDAGMRFGKCMNGKCACGGG | OSK1-Cit 16, D20, A34, G36-38 | 1046 |
| GVIINVKCKISRQCL[hCit]PCKDAGMRFGKCMNGKCACGGG | OSK1-hCit 16, D20, A34, G36-38 | 1047 |
| GVIINVKCKISRQCL[Dpr]PCKDAGMRFGKCMNGKCACGGG | OSK1-Dpr 16, D20, A34, G36-38 | 1048 |
| GVIINVKCKISRQCL[Dab]PCKDAGMRFGKCMNGKCACGGG | OSK1-Dab 16, D20, A34, G36-38 | 1049 |
| GVIINVKCKISRQCLKPCKDAGMRFGKCMNGKCACGG | Δ38, OSK1-K16, D20, A34, G36-37 | 1050 |
| GVIINVKCKISRQCLKPCKDAGMRFGKCMNGKCACYG | Δ38, OSK1-K16, D20, A35, Y36, G37 | 1051 |
| GVIINVKCKISRQCLOPCKDAGMRFGKCMNGKCACGG | Δ38, OSK1-O16, D20, A35, Y36, G37 | 1052 |
| GVIINVKCKISRQCL[hLys]PCKEAGMRFGKCMNGKCHCTPK | OSK1-hLys 16, E20 | 1053 |
| GVIINVKCKISRQCL[hArg]PCKEAGMRFGKCMNGKCHCTPK | OSK1-hArg 16, E20 | 1054 |
| GVIINVKCKISRQCL[Cit]PCKEAGMRFGKCMNGKCHCTPK | OSK1-Cit 16, E20 | 1055 |
| GVIINVKCKISRQCL[hCit]PCKEAGMRFGKCMNGKCHCTPK | OSK1-hCit 16, E20 | 1056 |
| GVIINVKCKISRQCL[Dpr]PCKEAGMRFGKCMNGKCHCTPK | OSK1-Dpr 16, E20 | 1057 |
| GVIINVKCKISRQCL[Dab]PCKEAGMRFGKCMNGKCHCTPK | OSK1-Dab 16, E20 | 1058 |
| GVIINVKCKISRQCLOPCKEAGMRFGKCMNGKCHCYPK | OSK1-O16, E20, Y36 | 1059 |
| GVIINVKCKISRQCL[hLys]PCKEAGMRFGKCMNGKCHCYPK | OSK1-hLys 16, E20, Y36 | 1060 |
| GVIINVKCKISRQCL[hArg]PCKEAGMRFGKCMNGKCHCYPK | OSK1-hArg 16, E20, Y36 | 1061 |

TABLE 7-continued

Orthochirus scrobiculosus (OSK1) peptide and OSK1 peptide analog sequences

| Sequence/structure | Short-hand designation | SEQ ID NO: |
|---|---|---|
| GVIINVKCKISRQCL[Cit]PCKEAGMRFGKCMNGKCHCYPK | OSK1-Cit 16, E20, Y36 | 1062 |
| GVIINVKCKISRQCL[hCit]PCKEAGMRFGKCMNGKCHCYPK | OSK1-hCit 16, E20, Y36 | 1063 |
| GVIINVKCKISRQCL[Dpr]PCKEAGMRFGKCMNGKCHCYPK | OSK1-Dpr 16, E20, Y36 | 1064 |
| GVIINVKCKISRQCL[Dab]PCKEAGMRFGKCMNGKCHCYPK | OSK1-Dab 16, E20, Y36 | 1065 |
| GVIINVKCKISRQCLOPCKEAGMRFGKCMNGKCACTPK | OSK1-O16, E20, A34 | 1066 |
| GVIINVKCKISRQCL[hLys]PCKEAGMRFGKCMNGKCACTPK | OSK1-hLys 16, E20, A34 | 1067 |
| GVIINVKCKISRQCL[hArg]PCKEAGMRFGKCMNGKCACTPK | OSK1-hArg 16, E20, A34 | 1068 |
| GVIINVKCKISRQCL[Cit]PCKEAGMRFGKCMNGKCACTPK | OSK1-Cit 16, E20, A34 | 1069 |
| GVIINVKCKISRQCL[hCit]PCKEAGMRFGKCMNGKCHCTPK | OSK1-hCit 16, E20, A34 | 1070 |
| GVIINVKCKISRQCL[Dpr]PCKEAGMRFGKCMNGKCACTPK | OSK1-Dpr 16, E20, A34 | 1071 |
| GVIINVKCKISRQCL[Dab]PCKEAGMRFGKCMNGKCACTPK | OSK1-Dab 16, E20, A34 | 1072 |
| GVIINVKCKISRQCLOPCKEAGMRPGKCMNGKCHC | Δ36-38, OSK1-O16, E20, | 1073 |
| GVIINVKCKISRQCL[hLys]PCKEAGMRFGKCMNGKCHC | Δ36-38, OSK1-hLys 16, E20 | 1074 |
| GVIINVKCKISRQCL[hArg]PCKEAGMRFGKCMNGKCHC | Δ36-38, OSK1-hArg 16, E20 | 1075 |
| GVIINVKCKISRQCL[Cit]PCKEAGMRFGKCMNGKCHC | Δ36-38, OSK1-Cit 16, E20 | 1076 |
| GVIINVKCKISRQCL[hCit]PCKEAGMREGKCMNGKCHC | Δ36-38, OSK1-hCit 16, E20 | 1077 |
| GVIINVKCKISRQCL[Dpr]PCKEAGMRFGKCMNGKCHC | Δ36-38, OSK1-Dpr 16, E20 | 1078 |
| GVIINVKCKISRQCLOPCKEAGMRFGKCMNGKCAC | Δ36-38, OSK1-O16, E20, A34 | 1079 |
| GVIINVKCKISRQCL[hLys]PCKEAGMRFGKCMNGKCAC | Δ36-38, OSK1-hLys 16, E20, A34 | 1080 |
| GVIINVKCKISRQCL[hArg]PCKEAGMRFGKCMNGKCAC | Δ36-38 OSK1-hArg 16, E20, A34 | 1081 |
| GVIINVKCKISRQCL[Cit]PCKEAGMRFGKCMNGKCAC | Δ36-38, OSK1-Cit 16, E20, A34 | 1082 |
| GVIINVKCKISRQCL[hCit]PCKEAGMRFGKCMNGKCHC | Δ36-38, OSK1-hCit 16, E20, A34 | 1083 |
| GVIINVKCKISRQCL[Dpr]PCKEAGMRFGKCMNGKCAC | Δ36-38, OSK1-Dpr 16, E20, A34 | 1084 |
| GVIINVKCKISRQCL[Dab]PCKEAGMRFGKCMNGKCAC | Δ36-38, OSK1-Dab 16, E20, A34 | 1085 |

TABLE 7-continued

Orthochirus scrobiculosus (OSK1) peptide and OSK1 peptide analog sequences

| Sequence/structure | Short-hand designation | SEQ ID NO: |
|---|---|---|
| GVIINVKCKISRQCLKPCKEAGMRFGKCMNGKCHCYGG | OSK1-K16, E20, Y36, G37, G38 | 1086 |
| GVIINVKCKISRQCLOPCKEAGMRFGKCMNGKCHCYGG | OSK1-O16, E20, Y36, G37, G38 | 1087 |
| GVIINVKCKISRQCLKPCKEAGMRFGKCMNGKCHCYG | Δ38 OSK1-K16, E20, Y36, G37 | 1088 |
| GVIINVKCKISRQCLKPCKEAGMRFGKCMNGKCACYG | Δ38 OSK1-K16, E20, A34, Y36, G37 | 1089 |
| GVIINVKCKISRQCL[hLys]PCKEAGMRFGKCMNGKCHCYGG | OSK1-hLys 16, E20, Y36, G37, G38 | 1090 |
| GVIINVKCKISRQCL[hArg]PCKEAGMRFGKCMNGKCHCYGG | OSK1-hArg 16, E20, Y36, G37, G38 | 1091 |
| GVIINVKCKISRQCL[Cit]PCKEAGMRFGKCMNGKCHCYGG | OSK1-Cit 16, E20, Y36, G37, G38 | 1092 |
| GVIINVKCKISRQCL[hCit]PCKEAGMRFGKCMNGKCHCYGG | Δ37-38, OSK1-ΔCit 16, E20, Y36, G37, G38 | 1093 |
| GVIINVKCKISRQCL[Dpr]PCKEAGMRFGKCMNGKCHCYGG | OSK1-Dpr 16, E20, Y36, G37, G38 | 1094 |
| GVIINVKCKISRQCL[Dab]PCKEAGMRFGKCMNGKCHCYGG | OSK1-Dab 16, E20, Y36, G37, G38 | 1095 |
| GVIINVKCKISRQCLKPCKEAGMRFGKCMNGKCACYG | Δ38, OSK1-K16, E20, A34, Y36, G37 | 1096 |
| GVIINVKCKISRQCLOPCKEAGMRFGKCMNGKCACYGG | OSK1-O16, E20, A34, Y36, G37, G38 | 1097 |
| GVIINVKCKISRQCL[hLys]PCKEAGMRFGKCMNGKCACYGG | OSK1-hLys 16, E20, A34, Y36, G37, G38 | 1098 |
| GVIINVKCKISRQCL[hArg]PCKEAGMRFGKCMNGKCACYGG | OSK1-hArg 16, E20, A34, Y36, G37, G38 | 1099 |
| GVIINVKCKISRQCL[Cit]PCKEAGMRFGKCMNGKCACYGG | OSK1-Cit 16, E20, A34, Y36, G37, G38 | 1100 |
| GVIINVKCKISRQCL[hCit]PCKEAGMREGKCMNGKCHCYGG | OSK1-hCit 16, E20, A34, Y3, G37, G38 | 1101 |
| GVIINVKCKISRQCL[Dpr]PCKEAGMRFGKCMNGKCACYGG | OSK1-Dpr 16, E20, A34, Y36, G37, G38 | 1102 |
| GVIINVKCKISRQCL[Dab]PCKEAGMRFGKCMNGKCACYGG | OSK1-Dab 16, E20, A34, Y36, G37, G38 | 1103 |

TABLE 7-continued

Orthochirus scrobiculosus (OSK1) peptide and OSK1 peptide analog sequences

| Sequence/structure | Short-hand designation | SEQ ID NO: |
|---|---|---|
| GVIINVKCKISRQCLKPCKEAGMRFGKCMNGKCACFGG | OSK1-K16, D20, A34, F36, G37, G38 | 1104 |
| GVIINVKCKISRQCLOPCKEAGMRFGKCMNGKCHCGGG | OSK1-O16, E20, G36-38 | 1105 |
| GVIINVKCKISRQCL[hLys]PCKEAGMREGKCMNGKCHCGGG | OSK1-hLys 16, E20, G36-38 | 1106 |
| GVIINVKCKISRQCL[hArg]PCKEAGMRFGKCMNGKCHCGGG | OSK1-hArg 16, E20, G36-38 | 1107 |
| GVIINVKCKISRQCL[Cit]PCKEAGMRFGKCMNGKCHCGGG | OSK1-Cit 16, E20, G36-38 | 1108 |
| GVIINVKCKISRQCL[hCit]PCKEAGMRFGKCMNGKCHCGGG | OSK1-hCit 16, E20, G36-38 | 1109 |
| GVIINVKCKISRQCL[Dpr]PCKEAGMRFGKCMNGKCHCGGG | OSK1-Dpr 16, E20, G36-38 | 1110 |
| GVIINVKCKISRQCLOPCKEAGMRFGKCMNGKCACGGG | OSK1-O16, E20, A34, G36-38 | 1111 |
| GVIINVKCKISRQCL[hLys]PCKEAGMRFGKCMNGKCACGGG | OSK1-hLys 16, E20, A34, G36-38 | 1112 |
| GVIINVKCKISRQCL[hArg]PCKEAGMRFGKCMNGKCACGGG | OSK1-hArg 16, E20, A34, G36-38 | 1113 |
| GVIINVKCKISRQCL[Cit]PCKEAGMRFGKCMNGKCACGGG | OSK1-Cit 16, E20, A34, G36-38 | 1114 |
| GVIINVKCKISRQCL[hCit]PCKEAGMRFGKCMNGKCACTP | OSK1-hCit 16, E20, A34, G36-38 | 1115 |
| GVIINVKCKISRQCL[Dpr]PCKEAGMRFGKCMNGKCACTP | OSK1-Dpr 16, E20, A34, G36-38 | 1116 |
| GVIINVKCKISRQCL[Dab]PCKEAGMRFGKCMNGKCACTP | OSK1-Dab 16, E20, A34, G36-38 | 1117 |
| GVIINVKCKISRQCLOPCKDAGMRFGKCMNGKCHCTPK-NH$_2$ | OSK1-O16, D20-amide | 1118 |
| GVIINVKCKISRQCL[hLys]PCKDAGMRFCKCMNGKCHCTPK-NH$_2$ | OSK1-hLys 16, D20-amide | 1119 |
| GVIINVKCKISRQCL[hArg]PCKDAGMRFGKCMNGKCHCTPK-NH$_2$ | OSK1-hArg 16, D20-amide | 1120 |
| GVIINVKCKISRQCL[Cit]PCKDAGMRFGKCMNGKCHCTPK-NH$_2$ | OSK1-Cit 16, D20-amide | 1121 |
| GVIINVKCKISRQCL[hCit]PCKDAGMRFGKCMNGKCHCTPK-NH$_2$ | OSK1-hCit 16, D20-amide | 1122 |
| GVIINVKCKISRQCL[Dpr]PCKDAGMRFGKCMNGKCHCTPK-NH$_2$ | OSK1-Dpr 16, D20-amide | 1123 |
| GVIINVKCKISRQCL[Dab]PCKDAGMRFGKCMNGKCHCTPK-NH$_2$ | OSK1-Dab 16, D20 | 1124 |
| GVIINVKCKISRQCLOPCKDAGMRFGKCMNGKCHCYPK-NH$_2$ | OSK1-O16, D20, Y36-amide | 1125 |
| GVIINVKCKISRQCL[hLys]PCKDAGMRFCKCMNGKCHCYPK-NH$_2$ | OSK1-hLys 16, D20, Y36-amide | 1126 |

TABLE 7-continued

Orthochirus scrobiculosus (OSK1) peptide and OSK1 peptide analog sequences

| Sequence/structure | Short-hand designation | SEQ ID NO: |
| --- | --- | --- |
| GVIINVKCKISRQCL[hArg]PCKDAGMRFGKCMNGKCHCYPK-NH$_2$ | OSK1-hArg 16, D20, Y36-amide | 1127 |
| GVIINVKCKISRQCL[Cit]PCKDAGMRFGKCMNGKCHCYPK-NH$_2$ | OSK1-Cit 16, D20, Y36-amide | 1128 |
| GVIINVKCKISRQCL[hCit]PCKDAGMRFGKCMNGKCHCYPK-NH$_2$ | OSK1-hCit 16, D20, Y36-amide | 1129 |
| GVIINVKCKISRQCL[Dpr]PCKDAGMRFGKCMNGKCHCYPK-NH$_2$ | OSK1-Dpr 16, D20, Y36-amide | 1130 |
| GVIINVKCKISRQCL[Dab]PCKDAGMRFGKCMNGKCHCYPK-NH$_2$ | OSK1-Dab 16, D20, Y36-amide | 1131 |
| GVIINVKCKISRQCLOPCKDAGMRFGKCMNGKCACTPK-NH$_2$ | OSK1-O16, D20, A34-amide | 1132 |
| GVIINVKCKISRQCL[hLys]PCKDAGMRFGKCMNGKCACTPK-NH$_2$ | OSK1-hLys 16, D20, A34-amide | 1133 |
| GVIINVKCKISRQCL[hArg]PCKDAGMRFGKCMNGKCACTPK-NH$_2$ | OSK1-hArg 16, D20, A34-amide | 1134 |
| GVIINVKCKISRQCL[Cit]PCKDAGMRFGKCMNGKCACTPK-NH$_2$ | OSK1-Cit 16, D20, A34-amide | 1135 |
| GVIINVKCKISRQCL[hCit]PCKDAGMRFGKCMNGKCACTPK-NH$_2$ | OSK1-hCit 16, D20, A34-amide | 1136 |
| GVIINVKCKISRQCL[Dpr]PCKDAGMRFGKCMNGKCACTPK-NH$_2$ | OSK1-Dpr 16, D20, A34-amide | 1137 |
| GVIINVKCKISRQCL[Dab]PCKDAGMRFGKCMNGKCACTPK-NH$_2$ | OSK1-Dab 16, D20, A34-amide | 1138 |
| GVIINVKCKISRQCLOPCKDAGMRFGKCMNGKCHC-NH$_2$ | Δ36-38, OSK1-O16, D20, -amide | 1139 |
| GVIINVKCKISRQCL[hLys]PCKDAGMRFGKCMNGKCHC-NH$_2$ | Δ36-38, OSK1-hLys 16, D20-amide | 1140 |
| GVIINVKCKISRQCL[hArg]PCKDAGMRFGKCMNGKCHC-NH$_2$ | Δ36-38, OSK1-hArg 16, D20-amide | 1141 |
| GVIINVKCKISRQCL[Cit]PCKDAGMRFGKCMNGKCHC-NH$_2$ | Δ36-38, OSK1-Cit 16, D20-amide | 1142 |
| GVIINVKCKISRQCL[hCit]PCKDAGMRFGKCMNGKCHC-NH$_2$ | Δ36-38, OSK1-hCit 16, D20-amide | 1143 |
| GVIINVKCKISRQCL[Dpr]PCKDAGMRFGKCMNGKCHC-NH$_2$ | Δ36-38, OSK1-Dpr 16, D20-amide | 1144 |

TABLE 7-continued

Orthochirus scrobiculosus (OSK1) peptide and OSK1 peptide analog sequences

| Sequence/structure | Short-hand designation | SEQ ID NO: |
|---|---|---|
| GVIINVKCKISRQCLOPCKDAGMRFGKGMNGKCAC-NH₂ | Δ36-38, OSK1-O16, D20, A34-amide | 1145 |
| GVIINVKCKISRQCL[hLys]PCKDAGMRFGKCMNGKCAC-NH₂ | Δ36-38, OSK1-hLys 16, D20, A34-amide | 1146 |
| GVIINVKCKISRQCL[hArg]PCKDAGMRFGKCMNGKCAC-NH₂ | Δ36-38, OSK1-hArg 16, D20, A34-amide | 1147 |
| GVIINVKCKISRQCL[Cit]PCKDAGMRFGKCMNGKCAC-NH₂ | Δ36-38, OSK1-Cit 16, D20, A34-amide | 1148 |
| GVIINVKCKISRQCL[hCit]PCKDAGMRFGKCMNGKCHC-NH₂ | Δ36-38, OSK1-hCit 16, D20, A34 | 1149 |
| GVIINVKCKISRQCL[Dpr]PCKDAGMRFGKCMNGKCAC-NH₂ | Δ36-38, OSK1-Dpr 16, D20, A34-amide | 1150 |
| GVIINVKCKISRQCL[Dab]PCKDAGMRFGKCMNGKCAC-NH₂ | Δ36-38, OSK1-Dab 16, D20, A34-amide | 1151 |
| GVIINVKCKISRQCLKPCKDAGMRFGKCMNGKCHCYGG-NH₂ | OSK1-O16, D20, Y36, G37, G38-amide | 1152 |
| GVIINVKCKISRQCLOPCKDAGMRFGKCMNGKCHCYGG-NH₂ | OSK1-O16, D20, Y36, G37, G38 | 1153 |
| GVIINVKCKISRQCL[hLys]PCKDAGMRFGKCMNGKCHCYGG-NH₂ | OSK1-hLys 16, D20, Y36, G37, G38-amide | 1154 |
| GVIINVKCKISRQCL[hArg]PCKDAGMRFGKCMNGKCHCYGG-NH₂ | OSK1-hArg 16, D20, Y36, G37, G38-amide | 1155 |
| GVIINVKCKISRQCL[Cit]PCKDAGMRFGKCMNGKCHCYGG-NH₂ | OSK1-Cit 16, D20, Y36, G37, G38-amide | 1156 |
| GVIINVKCKISRQCL[hCit]PCKDAGMRFGKCMNGKCHCYGG-NH₂ | OSK1-hCit 16, D20, Y36, G37, G38-amide | 1157 |
| GVIINVKCKISRQCL[Dpr]PCKDAGMRFGKCMNGKCHCYGG-NH₂ | OSK1-Dpr 16, D20, Y36, G37, G38-amide | 1158 |
| GVIINVKCKISRQCLKPCKDAGMRPGKCMNGKCHCFGG-NH₂ | OSK1-K16, D20, F36, G37, G38-amide | 1159 |
| GVIINVKCKISRQCLKPCKDAGMRFGKCMNGKCHCYG-NH₂ | Δ38-OSK1-K16, D20, Y36, G37-amide | 1160 |
| GVIINVKCKISRQCLKPCKDAGMRFGKCMNGKCACYG-NH₂ | Δ38-OSK1-K16, D20, A34, Y36, G37-amide | 1161 |
| GVIINVKCKISRQCLOPCKDAGMRFGKCMNGKCACYGG-NH₂ | OSK1-O16, D20, A34, Y36, G37, G38-amide | 1162 |

TABLE 7-continued

Orthochirus scrobiculosus (OSK1) peptide and OSK1 peptide analog sequences

| Sequence/structure | Short-hand designation | SEQ ID NO: |
|---|---|---|
| GVIINVKCKISRQCL[hLys]PCKDAGMRFGKCMNGKCACYGG-NH$_2$ | OSK1-hLys 16, D20, A34, Y36, G37, G38-amide | 1163 |
| GVIINVKCKISRQCL[hArg]PCKDAGMRFGKCMNGKCACYGG-NH$_2$ | OSK1-hArg 16, D20, A34, Y36, G37, G38-amide | 1164 |
| GVIINVKCKISRQCL[Cit]PCKDAGMRFGKCMNGKCACYGG-NH$_2$ | OSK1-Cit 16, D20, A34, Y36, G37, G38 | 1165 |
| GVIINVKCKISRQCL[hCit]PCKDAGMRFGKCMNGKCACYGG-NH$_2$ | OSK1-hCit 16, D20, A34, Y3, G37, G38-amide | 1166 |
| GVIINVKCKISRQCL[Dpr]PCKDAGMRFGKCMNGKCACYGG-NH$_2$ | OSK1-Dpr 16, D20, A34, Y36, G37, G38-amide | 1167 |
| GVIINVKCKISRQCL[Dab]PCKDAGMRFGKCMNGKCACYGG-NH$_2$ | OSK1-Dab 16, D20, A34, Y36, G37, G38-amide | 1168 |
| GVIINVKCKISRQCLKPGKDAGMRFGKCMNGKCACYGG-NH$_2$ | OSK1-K16, D20, A34, Y36, G37, G38-amide | 1169 |
| GVIINVKCKISRQCLOPCKDAGMRFGKGMNGKCHCGGG-NH$_2$ | OSK1-O16, D20, G36-38-amide | 1170 |
| GVIINVKCKISRQCL[hLys]PCKDAGMRFGKCMNGKCHCGGG-NH$_2$ | OSK1-hLys 16, D20, G36-38-amide | 1171 |
| GVIINVKCKISRQCL[hArg]PCKDAGMRFGKCMNGKCHCGGG-NH$_2$ | OSK1-hArg 16, D20, G36-38-amide | 1172 |
| GVIINVKCKISRQCL[Cit]PCKDAGMRFGKCMNGKCHCGGG-NH$_2$ | OSK1-Cit 16, D20, G36-38-amide | 1173 |
| GVIINVKCKISRQCL[hCit]PCKDAGMRFGKCMNGKCHCGGG-NH$_2$ | OSK1-hCit 16, D20, G36-38-amide | 1174 |
| GVIINVKCKISRQCL[Dpr]PCKDAGMRFGKCMNGKCHCGGG-NH$_2$ | OSK1-Dpr 16, D20, G36-38-amide | 1175 |
| GVIINVKCKISRQCLKPCKDAGMRFGKCMNGKCACGGG-NH$_2$ | OSK1-K16, D20, A34, G36-38-amide | 1176 |
| GVIINVKCKISRQCLOPCKDAGMRFGKCMNGKCACFGG-NH$_2$ | OSK1-O16, D20, A34, F36, G37-38-amide | 1177 |
| GVIINVKCKISRQCLOPCKDAGMRFGKCMNGKCACGGG-NH$_2$ | OSK1-O16, D20, A34, G36-38-amide | 1178 |
| GVIINVKCKISRQCL[hLys]PCKDAGMRFGKCMNGKCACGGG-NH$_2$ | OSK1-hLys 16, D20, A34, G36-38-amide | 1179 |
| GVIINVKCKTSRQCL[hArg]PCKDAGMRFGKCMNGKCACGGG-NH$_2$ | OSK1-hArg 16, D20, A34, G36-38-amide | 1180 |

TABLE 7-continued

Orthochirus scrobiculosus (OSK1) peptide and OSK1 peptide analog sequences

| Sequence/structure | Short-hand designation | SEQ ID NO: |
|---|---|---|
| GVIINVKCKISRQCL[Cit]PCKDAGMRFGKCMNGKCACGGG-NH$_2$ | OSK1-Cit 16, D20, A34, G36-38-amide | 1181 |
| GVIINVKCKISRQCL[hCit]PCKDAGMRFGKCMNGKCACGGG-NH$_2$ | OSK1-hCit 16, D20, A34, G36-38-amide | 1182 |
| GVIINVKCKISRQCL[Dpr]PCKDAGMRFGKCMNGKCACGGG-NH$_2$ | OSK1-Dpr 16, D20, A34, G36-38-amide | 1183 |
| GVIINVKCKISRQCL[Dab]PCKDAGMRFGKCMNGKCACGGG-NH$_2$ | OSK1-Dab 16, D20, A34, G36-38-amide | 1184 |
| GVIINVKCKISRQCLOPCKEAGMRFGKCMNGKCHCTPK-NH$_2$ | OSK1-O16, E20-amide | 1185 |
| GVIINVKCKISRQCL[hLys]PCKEAGMRFGKCMNGKCHCTPK-NH$_2$ | OSK1-hLys 16, E20-amide | 1186 |
| GVIINVKCKISRQCL[hArg]PCKEAGMRFGKCMNGKCHCTPK-NH$_2$ | OSK1-hArg 16, E20-amide | 1187 |
| GVIINVKCKISRQCL[Cit]PCKEAGMRFGKCMNGKCHCTPK-NH$_2$ | OSK1-Cit 16, E20-amide | 1188 |
| GVIINVKCKISRQCL[hCit]PCKEAGMRFGKCMNGKCHCTPK-NH$_2$ | OSK1-hCit 16, E20-amide | 1189 |
| GVIINVKCKISRQCL[Dpr]PCKEAGMRFGKCMNGKCHCTPK-NH$_2$ | OSK1-Dpr 16, E20-amide | 1190 |
| GVIINVKCKISRQCL[Dab]PCKEAGMRFGKCMNGKCHCTPK-NH$_2$ | OSK1-Dab 16, E20-amide | 1191 |
| GVIINVKCKISRQCLOPCKEAGMRFGKCMNGKCHCYPK-NH$_2$ | OSK1-O16, E20, Y36-amide | 1192 |
| GVIINVKCKISRQCL[hLys]PCKEAGMRFGKCMNGKCHCYPK-NH$_2$ | OSK1-hLys 16, E20, Y36-amide | 1193 |
| GVIINVKCKISRQCL[hArg]PCKEAGMRFGKCMNGKCHCYPK-NH$_2$ | OSK1-hArg 16, E20, Y36-amide | 1194 |
| GVIINVKCKISRQCL[Cit]PCKEAGMRFGKCMNGKCHCYPK-NH$_2$ | OSK1-Cit 16, E20, Y36-amide | 1195 |
| GVIINVKCKISRQCL[hCit]PCKEAGMRFGKCMNGKCHCYPK-NH$_2$ | OSK1-hCit 16, E20, Y36-amide | 1196 |
| GVIINVKCKISRQCL[Dpr]PCKEAGMRFGKCMNGKCHCYPK-NH$_2$ | OSK1-Dpr 16, E20, Y36-amide | 1197 |
| GVIINVKCKISRQCL[Dab]PCKEAGMRFGKCMNGKCHCYPK-NH$_2$ | OSK1-Dab 16, E20, Y36-amide | 1198 |
| GVIINVKCKISRQCLOPCKEAGMRFGKCMNGKCACTPK-NH$_2$ | OSK1-O16, E20, A34-amide | 1199 |

TABLE 7-continued

Orthochirus scrobiculosus (OSK1) peptide and OSK1 peptide analog sequences

| Sequence/structure | Short-hand designation | SEQ ID NO: |
|---|---|---|
| GVIINVKCKISRQCL[hLys]PCKEAGMRFGKCMNGKCACTPK-NH$_2$ | OSK1-hLys 16, E20, A34-amide | 1200 |
| GVIINVKCKISRQCL[hArg]PCKEAGMRFGKCMNGKCACTPK-NH$_2$ | OSK1-hArg 16, E20, A34-amide | 1201 |
| GVIINVKCKISRQCL[Cit]PCKEAGMRFGKCMNGKCACTPK-NH$_2$ | OSK1-Cit 16, E20, A34-amide | 1202 |
| GVIINVKCKISRQCL[hCit]PCKEAGMRFGKCMNGKCACTPK-NH$_2$ | OSK1-hCit 16, E20, A34-amide | 1203 |
| GVIINVKCKISRQCL[Dpr]PCKEAGMRFGKCMNGKCACTPK-NH$_2$ | OSK1-Dpr 16, E20, A34-amide | 1204 |
| GVIINVKCKISRQCL[Dab]PCKEAGMRFGKCMNGKCACTPK-NH$_2$ | OSK1-Dab 16, E20, A34-amide | 1205 |
| GVIINVKCKISRQCLOPCKEAGMRFGKCMNGKCHC-NH$_2$ | Δ36-38, OSK1-O16, E20, -amide | 1206 |
| GVIINVKCKISRQCL[hLys]PCKEAGMRFGKCMNGKCHC-NH$_2$ | Δ36-38, OSK1-hLys 16, E20-amide | 1207 |
| GVIINVKCKISRQCL[hArg]PCKEAGMRFGKCMNGKCHC-NH$_2$ | Δ36-38, OSK1-hArg 16, E20-amide | 1208 |
| GVIINVKCKISRQCL[Cit]PCKEAGMRFGKCMNGKCHC-NH$_2$ | Δ36-38, OSK1-Cit 16, E20-amide | 1209 |
| GVIINVKCKISRQCL[hCit]PCKEAGMRFGKCMNGKCHC-NH$_2$ | Δ36-38, OSK1-hCit 16, E20-amide | 1210 |
| GVIINVKCKISRQCL[Dpr]PCKEAGMRFGKCMNGKCHC-NH$_2$ | Δ36-38, OSK1-Dpr 16, E20-amide | 1211 |
| GVIINVKCKISRQCLOPCKEAGMRFGKCMNGKCAC-NH$_2$ | Δ36-38, OSK1-O16, E20, A34-amide | 1212 |
| GVIINVKCKISRQCL[hLys]PCKEAGMRFGKCMNGKCAC-NH$_2$ | Δ36-38, OSK1-hLys 16, E20, A34-amide | 1213 |
| GVIINVKCKISRQCL[hArg]PCKEAGMRFGKCMNGKCAC-NH$_2$ | Δ36-38, OSK1-hArg16, E20, A34-amide | 1214 |
| GVIINVKCKISRQCL[Cit]PCKEAGMRFGKCMNGKCAC-NH$_2$ | Δ36-38, OSK1-Cit 16, E20, A34-amide | 1215 |
| GVIINVKCKISRQCL[hCit]PCKEAGMRFGKCMNGKCHC-NH$_2$ | Δ36-38, OSK1-hCit 16, E20, A34-amide | 1216 |
| GVIINVKCKISRQCL[Dpr]PCKEAGMRFGKCMNGKCAC-NH$_2$ | Δ36-38, OSK1-Dpr 16, E20, A34-amide | 1217 |

TABLE 7-continued

Orthochirus scrobiculosus (OSK1) peptide and OSK1 peptide analog sequences

| Sequence/structure | Short-hand designation | SEQ ID NO: |
|---|---|---|
| GVIINVKCKISRQCL[Dab]PCKEAGMRFGKCMNGKCAC-NH$_2$ | Δ36-38, OSK1-Dab 16, E20, A34-amide | 1218 |
| GVIINVKCKISRQCLKPCKEAGMRFGKCMNGKCHCWGG-NH$_2$ | OSK1-O16, E20, W36, G37, G38-amide | 1219 |
| GVIINVKCKISRQCLOPCKEAGMRFGKCMNGKCHCYGG-NH$_2$ | OSK1-O16, E20, Y36, G37, G38-amide | 1220 |
| GVIINVKCKISRQCL[hLys]PCKEAGMRFGKCMNGKCHCYGG-NH$_2$ | OSK1-hLys 16, E20, Y36, G37, G38-amide | 1221 |
| GVIINVKCKISRQCL[hArg]PCKEAGMRFGKCMNGKCHCYGG-NH$_2$ | OSK1-hArg 16, E20, Y36, G37, G38-amide | 1222 |
| GVIINVKCKISRQCL[Cit]PCKEAGMRFGKCMNGKCHCYGG-NH$_2$ | OSK1-Cit 16, E20, Y36, G37, G38-amide | 1223 |
| GVIINVKCKISRQCL[hCit]PCKEAGMRFGKCMNGKCHCYGG-NH$_2$ | OSK1-hCit 16, E20, Y36, G37, G38-amide | 1224 |
| GVIINVKCKISRQCL[Dpr]PCKEAGMRFGKCMNGKCHCYGG-NH$_2$ | OSK1-Dpr 16, E20, Y36, G37, G38-amide | 1225 |
| GVIINVKCKISRQCL[Dab]PCKEAGMRFGKCMNGKCHCYGG-NH$_2$ | OSK1-Dpr 16, E20, Y36, G37, G38-amide | 1226 |
| GVIINVKCKISRQCLKPCKEAGMRFGKCMNGKCACYGG-NH$_2$ | OSK1-K16, E20, A34, Y36, G37, G38-amide | 1227 |
| GVIINVKCKISRQCLOPCKEAGMRFGKCMNGKCACYGG-NH$_2$ | OSK1-O16, E20, A34, Y36, G37, G38-amide | 1228 |
| GVIINVKCKISRQCL[hLys]PCKEAGMRFGKCMNGKCACYGG-NH$_2$ | OSK1-hLys 16, E20, A34, Y36, G37, G38-amide | 1229 |
| GVIINVKCKISRQCL[hArg]PCKEAGMRFGKCMNGKCACYGG-NH$_2$ | OSK1-hArg 16, E20, A34, Y36, G37, G38-amide | 1230 |
| GVIINVKCKISRQCL[Cit]PCKEAGMRFGKCMNGKCACYGG-NH$_2$ | OSK1-Cit 16, E20, A34, Y36, G37, G38-amide | 1231 |
| GVIINVKCKISRQCL[hCit]PCKEAGMRFGKCMNGKCHCYGG-NH$_2$ | OSK1-hCit 16, E20, A34, Y3, G37, G38-amide | 1232 |
| GVIINVKCKISRQCL[Dpr]PCKEAGMRFGKCMNGKCACYGG-NH$_2$ | OSK1-Dpr 16, E20, A34, Y36, G37, G38-amide | 1233 |
| GVIINVKCKISRQCL[Dab]PCKEAGMRFGKCMNGKCACYGG-NH$_2$ | OSK1-Dab 16, E20, A34, Y36, G37, G38-amide | 1234 |
| GVIINVKCKISRQCLOPCKEAGMRFGKCMNGKCHCGGG-NH$_2$ | OSK1-O16, E20, G36-38-amide | 1235 |

TABLE 7-continued

Orthochirus scrobiculosus (OSK1) peptide and OSK1 peptide analog sequences

| Sequence/structure | Short-hand designation | SEQ ID NO: |
|---|---|---|
| GVIINVKCKISRQCL[hLys]PCKEAGMRFGKCMNGKCHCGGG-NH$_2$ | OSK1-hLys 16, E20, G36-38-amide | 1236 |
| GVIINVKCKISRQCL[hArg]PCKEAGMRFGKCMNGKCHCGGG-NH$_2$ | OSK1-hArg 16, E20, G36-38-amide | 1237 |
| GVIINVKCKISRQCL[Cit]PCKEAGMRFGKCMNGKCHCGGG-NH$_2$ | OSK1-Cit 16, E20, G36-38-amide | 1238 |
| GVIINVKCKISRQCL[hCit]PCKEAGMRFGKCMNGKCHCGGG-NH$_2$ | OSK1-hCit 16, E20, G36-38-amide | 1239 |
| GVIINVKCKISRQCL[Dpr]PCKEAGMRFGKCMNGKCHCGGG-NH$_2$ | OSK1-Dpr 16, E20, G36-38-amide | 1240 |
| GVIINVKCKISRQCLOPCKEAGMRFGKCMNGKCACGGG-NH$_2$ | OSK1-O16, E20, A34, G36-38-amide | 1241 |
| GVIINVKCKISRQCL[hLys]PCKEAGMRFGKCMNGKCACGGG-NH$_2$ | OSK1-hLys 16, E20, A34, G36-38-amide | 1242 |
| GVIINVKCKISRQCL[hArg]PCKEAGMRFGKCMNGKCACGGG-NH$_2$ | OSK1-hArg 16, E20, A34, G36-38-amide | 1243 |
| GVIINVKCKISRQCL[Cit]PCKEAGMRECKCMNGKCACGGG-NH$_2$ | OSK1-Cit 16, E20, A34, G36-38-amide | 1244 |
| GVIINVKCKISRQCL[hCit]PCKEAGMRFGKCMNGKCACTP-NH$_2$ | Δ38 OSK1-hCit 16, E20, A34-amide | 1245 |
| GVIINVKCKISRQCL[Dpr]PCKEAGMRFGKCMNGKCACGGG-NH$_2$ | OSK1-Dpr 16, E20, A34, G36-38-amide | 1246 |
| GVIINVKCKISRQCL[Dab]PCKEAGMRFGKCMNGKCACGGG-NH$_2$ | OSK1-Dab 16, E20, A34, G36-38-amide | 1247 |
| GVIINVKCKISRQCLKPCK[Cpa]AGMRFGKCMNGKCACYGG-NH$_2$ | OSK1-K 16, CPA20, A34, Y36, G37, G38-amide | 1248 |
| GVIINVKCKISRQCLKPCK[Cpa]AGMRFGKCMNGKCACGGG-NH$_2$ | OSK1-K 16, CPA20, A34, G36-38-amide | 1249 |
| GVIINVKCKISRQCLKPCK[Cpa]AGMRFGKCMNGKCACY-NH$_2$ | A37-38OSK1-K 16, CPA20, A34, Y36-amide | 1250 |
| Ac-GVIINVKCKISRQCLKPCKDAGMRFGKCMNGKCACYGG-NH$_2$ | Acetyl-OSK1-K 16, D20, A34, Y36, G37, G38-amide | 1251 |
| GVIINVKCKISRQCLKPCK[Aad]AGMRFGKCMNGKCACYGC-NH$_2$ | OSK1-K 16, Aad20, A34, Y36, G37 G38-amide | 1252 |
| GVIINVKCKISRQCLKPCK[Aad]AGMRFGKCMNGKCHCYGG-NH$_2$ | OSK1-K 16, Aad20, Y36, G37, G38-amide | 1253 |

TABLE 7-continued

Orthochirus scrobiculosus (OSK1) peptide and OSK1 peptide analog sequences

| Sequence/structure | Short-hand designation | SEQ ID NO: |
|---|---|---|
| GVIINVKCKISRQCLKPCK[Aad]AGMRFGKCMNGKCACYGG | OSK1-K 16, Aad20, A34, Y36, G37, G38 | 1254 |
| GVIINVKCKISRQCLHPCKDAGMRFGKCMNGKCACYGG-NH$_2$ | OSK1-H 16, D20, A34, Y36, G37, G38-amide | 1255 |
| GVIINVKCKISRQCLHPCKDAGMRFGKCMNGKCACYGG | OSK1-H 16, D20, A34, Y36, G37, G38 | 1256 |
| GVIINVKCKISRQCLHPCKDAGMRFGKCMNGKCACY-NH$_2$ | Δ37-38-OSK1-H 16, D20, A34, Y36-amide | 1257 |
| GVIINVKCKISRQCLHPCKDACMRFGKCMNGKCHCYGG-NH$_2$ | OSK1-H 16, D20, A34, Y36, G37, G38-amide | 1258 |
| GVIINVKCKISRQCLHPCKDAGMRFGKCMNGKCHCYGG | OSK1-H 16, D20, A34, Y36, G37, G38 | 1259 |
| GVIINVKCKISRQCLHPCKDAGMRFGKCMNGKCHCYPK | OSK1-H 16, D20, A34, Y36, | 1260 |
| GVIINVKCKISRQCLHPCKDAGMRFGKCMNGKCAC | Δ36-38 OSK1-H 16, D20, A34, Y36, | 1261 |
| GVIINVKCKISRQCLKPCKDAGMRFGKCMNGKCAC[1Nal]GG-NH$_2$ | OSK1-K 16, D20, A34, 1Nal36, G37, G38-amide | 1262 |
| GVIINVKCKISRQCLKPCKDAGMRFGKCMNGKCAC[1Nal]PK-NH$_2$ | OSK1-K 16, D20, A34, 1Nal36-amide | 1263 |
| GVIINVKCKISRQCLKPCKDAGMRFGKCMNGKCAC[2Nal]GG-NH$_2$ | OSK1-K 16, D20, A34, 2Nal36, G37, G38-amide | 1264 |
| GVIINVKCKISRQCLKPCKDAGMRFGKCMNGKCAC[Cha]GG-NH$_2$ | OSK1-K 16, D20, A34, Cha36, G37, G38-amide | 1265 |
| GVIINVKCKISRQCLKPCKDAGMRFGKCMNCKCAC[MePhe]GG-NH$_2$ | OSK1-K 16, D20, A34, MePhe36, G37, G38-amide | 1266 |
| GVIINVKCKISRQCLKPCKDAGMRFGKCMNGKCAC[BiphA]GG-NH$_2$ | OSK1-K 16, D20, A34, BiPhA36, G37, G38-amide | 1267 |
| GVIINVKCKISRQCLKPCKDAGMRFGKCMNGK[Aib]CYGG-NH$_2$ | OSK1-K 16, D20, Aib34, Y36, G37, G38-amide | 1268 |
| GVIINVKCKISRQCLKPCKDAGMRFGKCMNGK[Abu]CYGG-NH$_2$ | OSK1-K 16, D20, Abu34, Y36, G37, G38-amide | 1269 |
| GVIINVKCKISRQCLKPCKDAGMRFGKCMNGKCAC[1Nal] | Δ37-38 OSK1-H 16, D20, A34, 1Nal36,-amide | 1270 |

TABLE 7-continued

Orthochirus scrobiculosus (OSK1) peptide and OSK1 peptide analog sequences

| Sequence/structure | Short-hand designation | SEQ ID NO: |
|---|---|---|
| GVIINVKCKISRQCLHPCKDAGMRFGKCMNGKCAC[1Nal]GG-NH$_2$ | OSK1-H 16, D20, A34, 1Nal36, G37, G38-amide | 1271 |
| GVIINVKCKISRQCLKPCKDAGMRFGKCMNGKCAC[4Bip]-NH$_2$ | Δ37-38 OSK1-H 16, D20, A34, 4Bip 36, -amide | 1272 |
| GVIINVKCKISRQCLHPCKDAGMRFGKCMNGKCAC[4Bip]GG-NH$_2$ | OSK1-H 16, D20, A34, 4Bip 36, G37, G38-amide | 1273 |
| GVIINVKCKISRQCLKPCKDAGMRFGKCMNGKCHCGGG | OSK1-K16, E20, G36-38 | 1274 |

Any of the sequences set forth in Table 7, can also be derivatized at either its N-terminal or C-terminal with a fatty acid having from 4 to 10 carbon atoms and from 0 to 2 carbon-carbon double bonds, or a derivative thereof such as an ω-amino-fatty acid. (E.g., Mouhat et al., WO 2006/002850 A2, which is incorporated by reference in its entirety). Examples of such fatty acids include valeric acid or (for the C-terminal) ω-amino-valeric acid

TABLE 8

Pi2 peptide and PiP2 s peptide analog equences

| Sequence/structure | Short-hand designation | SEQ ID NO: |
|---|---|---|
| TISCTNPKQCYPHCKKETGYPNAKCMNRKCKCFGR | Pi2 | 17 |
| TISCTNPXQCYPHCKKETGYPNAKCMNRKCKCFGR | Pi2-X8 | 299 |
| TISCTNPAQCYPHCKKETGYPNAKCMNRKCKCFGR | Pi2-A8 | 300 |
| TISCTNPKQCYPHCXKETGYPNAKCMNRKCKCFGR | Pi2-X15 | 301 |
| TISCTNPKQCYPHCAKETGYPNAKCMNRKCKCFGR | Pi2-A15 | 302 |
| TISCTNPKQCYPHCKXETGYPNAKCMNRKCKCFGR | Pi2-X16 | 303 |
| TISCTNPKQCYPHCKAETGYPNAKCMNRKCKCFGR | Pi2-A16 | 304 |
| TISCTNPKQCYPHCKKETGYPNAXCMNRKCKCFGR | Pi2-X24 | 305 |
| TISCTNPKQCYPHCKKETGYPNAACMNRKCKCFGR | Pi2-A24 | 306 |
| TISCTNPKQCYPHCKKETGYPNAKCMNXKCKCFGR | Pi2-X28 | 307 |
| TISCTNPKQCYPHCKKETGYPNAKCMNAKCKCFGR | Pi2-A28 | 308 |
| TISCTNPKQCYPHCKKETGYPNAKCMNRXCKCFGR | Pi2-X29 | 309 |
| TISCTNPKQCYPHCKKETGYPNAKCMNRACKCFGR | Pi2-A29 | 310 |
| TISCTNPKQCYPHCKKETGYPNAKCMNRKCXCFGR | Pi2-X31 | 311 |
| TISCTNPKQCYPHCKKETGYPNAKCMNRKCACFGR | Pi2-A31 | 312 |
| TISCTNPKQCYPHCKKETGYPNAKCMNRKCKCFGX | Pi2-X35 | 313 |
| TISCTNPKQCYPHCKKETGYPNAKCMNRKCKCFGA | Pi2-A35 | 314 |
| TISCTNPKQCYPHCKKETGYPNAKCMNRKCKCFG | Pi2-d35 | 315 |

TABLE 9

Anuroctoxin (AnTx) peptide and peptide analog sequences

| Sequence/structure | Short-hand designation | SEQ ID NO: |
|---|---|---|
| ZKECTGPQHCTNFCRKNKCTHGKCMNRKCKCFNCK | Anuroctoxin (AnTx) | 62 |
| KECTGPQHCTNFCRKNKCTHGKCMNRKCKCFNCK | AnTx-d1 | 316 |
| XECTGPQHCTNFCRKNKCTHGKCMNRKCKCFNCK | AnTx-d1, X2 | 317 |
| AECTGPQHCTNFCRKNKCTHGKCMNRKCKCFNCK | AnTx-d1, A2 | 318 |

TABLE 10

Noxiustoxin (NTX) peptide and NTX peptide analog sequences

| Sequence/structure | Short-hand designation | SEQ ID NO: |
|---|---|---|
| TIINVKCTSPKQCSKPCKELYGSSAGAKCMNGKCKCYNN | NTX | 30 |
| TIINVACTSPKQCSKPCKELYGSSAGAKCMNGKCKCYNN | NTX-A6 | 319 |
| TIINVKCTSPKQCSKPCKELYGSSRGAKCMNGKCKCYNN | NTX-R25 | 320 |

TABLE 10-continued

Noxiustoxin (NTX) peptide and NTX peptide analog sequences

| Sequence/structure | Short-hand designation | SEQ ID NO: |
|---|---|---|
| TIINVKCTSSKQCSKPCKELYGSSAGAKCMNGKCKCYNN | NTX-S10 | 321 |
| TIINVKCTSPKQCWKPCKELYGSSAGAKCMNGKCKCYNN | NTX-W14 | 322 |
| TIINVKCTSPKQCSKPCKELYGSSGAXCMNGKCKCYNN | NTX-A25d | 323 |
| TIINVKCTSPKQCSKPCKELFGVDRGKCMNGKCKCYNN | NTX-IbTx1 | 324 |
| TIINVKCTSPKQCWKPCKELFGVDRGKCMNGKCKCYN | NTX-IBTX2 | 325 |

TABLE 11

Kaliotoxin1 (KTX1) peptide and KTX1 peptide analog sequences

| Sequence/structure | Short-hand designation | SEQ ID NO: |
|---|---|---|
| GVEINVKCSGSPQCLKPCKDAGMRFGKCMNRKCHCTPK | KTX1 | 24 |
| VRIPVSCKHSGQCLKPCKDAGMRFGKCMNGKCDCTPK | KTX2 | 326 |
| GVEINVSCSGSPQCLKPCKDAGMRFGKCMNRKCHCTPK | KTX1-S7 | 327 |
| GVEINVACSGSPQCLKPCKDAGMRFGKCMNRKCHCTPK | KTX1-A7 | 328 |

TABLE 12

IKCa1 inhibitor peptide sequences

| Sequence/structure | Short-hand designation | SEQ ID NO: |
|---|---|---|
| VSCTGSKDCYAPCRKQTGCPNAKCINKSCKCYGC | MTX | 20 |
| QFTNVSCTTSKECWSVCQRLHNTSRGKCMNKKCRCYS | ChTx | 36 |
| QFTQESCTASNQCWSICKRLHNTNRGKCMNKKCRCYS | ChTx-Lq2 | 329 |

TABLE 13

Maurotoxin (MTx) peptide amd MTx peptide analog sequences

| Sequence/structure | Short-hand designation | SEQ ID NO: |
|---|---|---|
| VSCTGSKDCYAPCRKQTGCPNAKCINKSCKCYGC | MTX | 20 |
| VSCAGSKDCYAPCRKQTGCPNAKCINKSCKCYGC | MTX-A4 | 330 |
| VSCTGAKDCYAPCRKQTGCPNAKCINKSCKCYGC | MTX-A6 | 331 |
| VSCTGSADCYAPCRKQTGCPNAKCINKSCKCYGC | MTX-A7 | 332 |
| VSCTGSKDCAAPCRKQTGCPNAKCINKSCKCYGC | MTX-A10 | 333 |
| VSCTGSKDCYAPCQKQTGCPNAKCINKSCKCYGC | MTX-Q14 | 334 |
| VSCTGSKDCYAPCRQQTGCPNAKCINKSCKCYGC | MTX-Q15 | 335 |
| VSCTGSKDCYAPCQQQTGCPNAKCINKSCKCYGC | MTX-Q14, 15 | 336 |
| VSCTGSKDCYAPCRKQTGCPNAKCINKSCKCYAC | MTX-A33 | 337 |
| VSCTGSKDCYAPCRKQTGCPYGKCMNRKCKCNRC | MTX-HsTx1 | 338 |
| VSCTGSKDCYAACRKQTGCANAKCINKSCKCYGC | MTX-A12, 20 | 339 |
| VSCTGSKDCYAPCRKQTGX$^{M19}$PNAKCINKSCKCYGX$^{M34}$ | MTX-X19, 34 | 340 |
| VSCTGSKDCYAPCRKQTGSPNAKCINKSCKCYGS | MTX-S19, 34 | 341 |
| VSCTGSADCYAPCRKQTGCPNAKCINKSCKCYGC | MTX-A7 | 342 |
| VVIGQRCTGSKDCYAPCRKQTGCPNAKCINKSCKCYGC | TsK-MTX | 343 |
| VSCRGSKDCYAPCRKQTGCPNAKCINKSCKCYGC | MTX-R4 | 1301 |
| VSCGGSKDCYAPCRKQTGCPNAKCINKSCKCYGC | MTX-G4 | 1302 |

TABLE 13-continued

Maurotoxin (MTx) peptide amd MTx peptide analog sequences

| Sequence/structure | Short-hand designation | SEQ ID NO: |
|---|---|---|
| VSCTTSKDCYAPCRKQTGCPNAKCINKSCKCYGC | MTX-T5 | 1304 |
| VSCTASKDCYAPCRKQTGCPNAKCINKSCKCYGC | MTX-A5 | 1305 |
| VSCTGTKDCYAPCRKQTGCPNAKCINKSCKCYGC | MTX-T6 | 1306 |
| VSCTGPKDCYAPCRKQTGCPNAKCINKSCKCYGC | MTX-P6 | 1307 |
| VSCTGSKDCGAPCRKQTGCPNAKCINKSCKCYGC | MTX-G10 | 1309 |
| VSCTGSKDCYRPCRKQTGCPNAKCINKSCKCYGC | MTX-R11 | 1311 |
| VSCTGSKDCYDPCRKQTGCPNAKCINKSCKCYGC | MTX-D11 | 1312 |
| VSCTGSKDCYAPCRKRTGCPNAKCINKSCKCYGC | MTX-R16 | 1315 |
| VSCTGSKDCYAPCRKETGCPNAKCINKSCKCYGC | MTX-E16 | 1316 |
| VSCTGSKDCYAPCRKQTGCPYAKCINKSCKCYGC | MTX-Y21 | 1317 |
| VSCTGSKDCYAPCRKQTGCPNSKCINKSCKCYGC | MTX-S22 | 1318 |
| VSCTGSKDCYAPCRKQTGCPNGKCINKSCKCYGC | MTX-G22 | 1319 |
| VSCTGSKDCYAPCRKQTGCPNAKCINRSCKCYGC | MTX-R27 | 1320 |
| VSCTGSKDCYAPCRKQTGCPNAKCINKTCKCYGC | MTX-T28 | 1321 |
| VSCTGSKDCYAPCRKQTGCPNAKCINKMCKCYGC | MTX-M28 | 1322 |
| VSCTGSKDCYAPCRKQTGCPNAKCINKKCKCYGC | MTX-K28 | 1323 |
| VSCTGSKDCYAPCRKQTGCPNAKCINKSCKCNGC | MTX-N32 | 1324 |
| VSCTGSKDCYAPCRKQTGCPNAKCINKSCKCYRC | MTX-R33 | 1325 |
| VSCTGSKDCYAPCRKQTGCPNAKCINKSCKCYGCS | MTX-S35 | 1326 |
| SCTGSKDCYAPCRKQTGCPNAKCINKSCKCYGC | MTX-d1 | 1327 |
| SCTGSKDCYAPCRKQTGCPNAKCINKSCKCYGCS | MTX-S35 d1 | 1328 |
| VSCTGSKDCYAPCAKQTGCPNAKCINKSCKCYGC | MTX-A14 | 1329 |
| VSCTGSKDCYAPCRAQTGCPNAKCINKSCKCYGC | MTX-A15 | 1330 |
| VSCTGSKDCYAPCRKQTGCPNAACINKSCKCYGC | MTX-A23 | 1331 |
| VSCTGSKDCYAPCRKQTGCPNAKCINASCKCYGC | MTX-A27 | 1332 |
| VSCTGSKDCYAPCRKQTGCPNAKCINKSCACYGC | MTX-A30 | 1333 |
| VSCTGSKDCYAPCRKQTGCPNAKCINKSCKCAGC | MTX-A32 | 1334 |
| ASCTGSKDCYAPCRKQTGCPNAKCINKSCKCYGC | MTX-A1 | 1335 |
| MSCTGSKDCYAPCRKQTGCPNAKCINKSCKCYGC | MTX-M1 | 1336 |

In Table 13 and throughout this specification, $X^{m19}$ and $X^{m34}$ are each independently nonfunctional residues.

TABLE 14

Charybdotoxin(ChTx) peptide and ChTx peptide analog sequences

| Sequence/structure | Short-hand designation | SEQ ID NO: |
|---|---|---|
| QFTNVSCTTSKECWSVCQRLHNTSRGKCMNKKCRCYS | ChTx | 36 |
| QFTNVSCTTSKECWSVCQRLHNTSRGKCMNKECRCYS | ChTx-E32 | 59 |
| QFTNVSCTTSKECWSVCQRLHNTSRGKCMNKDCRCYS | ChTx-D32 | 344 |
| CTTSKECWSVCQRLHNTSRGKCMNKKCRCYS | ChTx-d1-d6 | 345 |
| QFTNVSCTTSKECWSVCQRLFGVDRGKCMGKKCRCYQ | ChTx-IbTx | 346 |
| QFTNVSCTTSKECWSVCQRLHNTSRGKCMNGKCRCYS | ChTx-G31 | 1369 |
| QFTNVSCTTSKECLSVCQRLHNTSRGKCMNKKCRCYS | ChTx-L14 | 1370 |
| QFTNVSCTTSKECASVCQRLHNTSRGKCMNKKCRCYS | ChTx-A14 | 1371 |
| QFTNVSCTTSKECWAVCQRLHNTSRGKCMNKKCRCYS | ChTx-A15 | 1372 |
| QFTNVSCTTSKECWPVCQRLHNTSRGKCMNKKCRCYS | ChTx-P15 | 1373 |
| QFTNVSCTTSKECWSACQRLHNTSRGKCMNKKCRCYS | ChTx-A16 | 1374 |
| QFTNVSCTTSKECWSPCQRLHNTSRGKCMNKKCRCYS | ChTx-P16 | 1375 |
| QFTNVSCTTSKECWSVCQRLHNTSAGKCMNKKCRCYS | ChTx-A25 | 1376 |
| QFTNVACTTSKECWSVCQRLHNTSRGKCMNKKCRCYS | ChTx-A6 | 1377 |
| QFTNVKCTTSKECWSVCQRLHNTSRGKCMNKKCRCYS | ChTx-K6 | 1378 |
| QFTNVSCTTAKECWSVCQRLHNTSRGKCMNKKCRCYS | ChTx-A10 | 1379 |
| QFTNVSCTTPKECWSVCQRLHNTSRGKCMNKKCRCYS | ChTx-P10 | 1380 |
| QFTNVSCTTSKACWSVCQRLHNTSRGKCMNKKCRCYS | ChTx-A12 | 1381 |
| QFTNVSCTTSKQCWSVCQRLHNTSRGKCMNKKCRCYS | ChTx-Q12 | 1382 |
| AFTNVSCTTSKECWSVCQRLHNTSRGKCMNKKCRCYS | ChTx-A1 | 1383 |
| TFTNVSCTTSKECWSVCQRLHNTSRGKCMNKKCRCYS | ChTx-T1 | 1384 |
| QATNVSCTTSKECWSVCQRLHNTSRGKCMNKKCRCYS | ChTx-A2 | 1385 |
| QITNVSCTTSKECWSVCQRLHNTSRGKCMNKKCRCYS | ChTx-I2 | 1386 |
| QFANVSCTTSKECWSVCQRLHNTSRGKCMNKKCRCYS | ChTx-A3 | 1387 |
| QFINVSCTTSKECWSVCQRLHNTSRGKCMNKKCRCYS | ChTx-I3 | 1388 |
| TIINVKCTSPKQCLPPCKAQFGTSRGKCMNKKCRCYSP | ChTx-MgTx | 1389 |
| TIINVSCTSPKQCLPPCKAQFGTSRGKCMNKKCRCYSP | ChTx-MgTx-b | 1390 |

TABLE 15

SKCa inhibitor peptide sequences

| Sequence/structure | Short-hand designation | SEQ ID NO: |
|---|---|---|
| CNCKAPETALCARRCQQHG | Apamin | 68 |
| AFCNLRMCQLSCRSLGLLGKCIGDKCECVKH | ScyTx | 51 |
| AVCNLKRCQLSCRSLGLLGKCIGDKCECVKHG | BmP05 | 50 |
| TVCNLRRCQLSCRSLGLLGKCIGVKCECVKH | P05 | 52 |
| AFCNLRRCELSCRSLGLLGKCIGEECKCVPY | Tamapin | 53 |
| VSCEDCPEHCSTQKAQAKCDNDKCVCEPI | P01 | 16 |
| VVIGQRCYRSPDCYSACKKLVGKATGKCTNGRCDC | TsK | 47 |

TABLE 16

Apamin peptide and peptide analog inhibitor sequences

| Sequence/structure | Short-hand designation | SEQ ID NO: |
|---|---|---|
| CNCKAPETALCARRCQQHG | Apamin (Ap) | 68 |
| CNCXAPETALCARRCQQHG | Ap-X4 | 348 |
| CNCAAPETALCARRCQQHG | Ap-A4 | 349 |
| CNCKAPETALCAXRCQQHG | Ap-X13 | 350 |
| CNCKAPETALCAARCQQHG | Ap-A13 | 351 |
| CNCKAPETALCARXCQQHG | Ap-X14 | 352 |
| CNCKAPETALCARACQQHG | Ap-A14 | 353 |

TABLE 17

Scyllatoxin (ScyTx), BmP05, P05, Tamapin, P01 peptide and peptide analog inhibitor sequences

| Sequence/structure | Short-hand designation | SEQ ID NO: |
|---|---|---|
| AFCNLRMCQLSCRSLGLLGKCIGDKCECVKH | ScyTx | 51 |
| AFCNLRRCQLSCRSLGLLGKCIGDKCECVKH | ScyTx-R7 | 354 |
| AFCNLRMCQLSCRSLGLLGKCMGKKCRCVKH | ScyTx-IbTx | 355 |
| AFSNLRMCQLSCRSLGLLGKSIGDKCECVKH | ScyTx-C/S | 356 |
| AFCNLRRCELSCRSLGLLGKCIGEECKCVPY | Tamapin | 53 |

TABLE 18

BKCa inhibitor peptide sequences

| Sequence/structure | Short-hand designation | SEQ ID NO: |
|---|---|---|
| QFTDVDCSVSKECWSVCKDLFGVDRGKCMGKKCRCYQ | IbTx | 38 |
| TFIDVDCTVSKECWAPCKAAFGVDRGKCMGKKCKCYV | Slotoxin (Slo-TX) | 39 |
| QFTDVKCTGSKQCWPVCKQMFGKPNGKCMNGKCRCYS | BmTx1 | 40 |
| WCSTCLDLACGASRECYDPCFKAFGRAHGKCMNNKCRCYTN | BuTx | 41 |
| FGLIDVKCFASSECWTACKKVTGSGQGKCQNNQCRCY | MartenTx | 35 |
| ITINVKCTSPQQCLRPCKDRFGQHAGGKCINGKCKCYP | CllTx1 | 29 |

TABLE 19

IbTx, Slotoxin, BmTx1, & BuTX (Slotoxin family) peptide and peptide analog inhibitor sequences

| Sequence/structure | Short-hand designation | SEQ ID NO: |
|---|---|---|
| QFTDVDCSVSKECWSVCKDLFGVDRGKCMGKKCRCYQ | IbTx | 38 |
| QFTDVDCSVSXECWSVCKDLFGVDRGKCMGKKCRCYQ | IbTx-X11 | 357 |
| QFTDVDCSVSAECWSVCKDLFGVDRGKCMGKKCRCYQ | IbTx-A11 | 358 |
| QFTDVDCSVSKECWSVCXDLFGVDRGKCMGKKCRCYQ | IbTx-X18 | 359 |
| QFTDVDCSVSKECWSVCADLFGVDRGKCMGKKCRCYQ | IbTx-A18 | 360 |
| QFTDVDCSVSKECWSVCKDLFGVDXGKCMGKKCRCYQ | IbTx-X25 | 361 |
| QFTDVDCSVSKECWSVCKDLFGVDAGKCMGKKCRCYQ | IbTx-A25 | 362 |
| QFTDVDCSVSKECWSVCKDLFGVDRGXCMGKKCRCYQ | IbTx-X27 | 363 |
| QFTDVDCSVSKECWSVCKDLFGVDRGACMGKKCRCYQ | IbTx-A27 | 364 |
| QFTDVDCSVSKECWSVCKDLFGVDRGKCMGXKCRCYQ | IbTx-X31 | 365 |
| QFTDVDCSVSKECWSVCKDLFGVDRGKCMGAKCRCYQ | IbTx-A31 | 366 |
| QFTDVDCSVSKECWSVCKDLFGVDRGKCMGKXCRCYQ | IbTx-X32 | 367 |
| QFTDVDCSVSKECWSVCKDLFGVDRGKCMGKACRCYQ | IbTx-A32 | 368 |
| QFTDVDCSVSKECWSVCKDLFGVDRGKCMGKKCXCYQ | IbTx-X34 | 369 |
| QFTDVDCSVSKECWSVCKDLFGVDRGKCMGKKCACYQ | IbTx-A34 | 370 |
| QFTDVKCTGSKQCWPVCKQMFGKPNGKCMNGKCRCYS | BmTx1 | 371 |
| QFTDVXCTGSKQCWPVCKQMFGKPNGKCMNGKCRCYS | BmTx1-X6 | 372 |
| QFTDVACTGSKQCWPVCKQMFGKPNGKCMNGKCRCYS | BmTx1-A6 | 373 |
| QFTDVKCTGSXQCWPVCKQMFGKPNGKCMNGKCRCYS | BmTx1-X11 | 374 |
| QFTDVKCTGSAQCWPVCKQMFGKPNGKCMNGKCRCYS | BmTx1-A11 | 375 |
| QFTDVKCTGSKQCWPVCXQMFGKPNGKCMNGKCRCYS | BmTx1-X18 | 376 |
| QFTDVKCTGSKQCWPVCAQMFGKPNGKCMNGKCRCYS | BmTx1-A18 | 377 |
| QFTDVKCTGSKQCWPVCKQMFGXPNGKCMNGKCRCYS | BmTx1-X23 | 378 |
| QFTDVKCTGSKQCWPVCKQMFGAPNGKCMNGKCRCYS | BmTx1-A23 | 379 |
| QFTDVKCTGSKQCWPVCKQMFGKPNGXCMNGKCRCYS | BmTx1-X27 | 380 |
| QFTDVKCTGSKQCWPVCKQMFGKPNGACMNGKCRCYS | BmTx1-A27 | 381 |
| QFTDVKCTGSKQCWPVCKQMFGKPNGKCMNGXCRCYS | BmTx1-X32 | 382 |
| QFTDVKCTGSKQCWPVCKQMFGKPNGKCMNGARCYS | BmTx1-A32 | 383 |
| QFTDVKCTGSKQCWPVCKQMFGKPNGKCMNGKCXYS | BmTx1-X34 | 384 |
| QFTDVKCTGSKQCWPVCKQMFGKPNGKCMNGKCAYS | BmTx1-A34 | 385 |

TABLE 19-continued

IbTx, Slotoxin, BmTx1, & BuTX (Slotoxin family) peptide and peptide analog inhibitor sequences

| Sequence/structure | Short-hand designation | SEQ ID NO: |
|---|---|---|
| WCSTCLDLACGASRECYDPCFKAFGRAHGKCMNNKCRCYTN | BuTx | 386 |
| WCSTCLDLACGASXCYDPCFKAFGRAHGKCMNNKCRCYTN | BuTx-X14 | 387 |
| WCSTCLDLACGASACYDPCFKAFGRAHGKCMNNKCRCYTN | BuTx-A14 | 388 |
| WCSTCLDLACGASRECYDPCFXFGRAHGKCMNNKCRCYTN | BuTx-X22 | 389 |
| WCSTCLDLACGASRECYDPCFAGRAHGKCMNNKCRCYTN | BuTx-A22 | 390 |
| WCSTCLDLACGASRECYDPCFKAFGXHGKCMNNKCRCYTN | BuTx-X26 | 391 |
| WCSTCLDLACGASRECYDPCFKAFGAHGKCMNNKCRCYTN | BuTx-A26 | 392 |
| WCSTCLDLACGASRECYDPCFKAFGRAHGXMNNKCRCYTN | BuTx-X30 | 393 |
| WCSTCLDLACGASRECYDPCFKAFGRAHGAMNNKCRCYTN | BuTx-A30 | 394 |
| WCSTCLDLACGASRECYDPCFKAFGRAHGKCMNNXRCYTN | BuTx-X35 | 395 |
| WCSTCLDLACGASRECYDPCFKAFGRAHGKCMNNARCYTN | BuTx-A35 | 396 |
| WCSTCLDLACGASRECYDPCFKAFGRAHGKCMNNKCXYTN | BuTx-X37 | 397 |
| WCSTCLDLACGASRECYDPCFKAFGRAHGKCMNNKCAYTN | BuTx-A37 | 398 |

TABLE 20

Martentoxin peptide and peptide analog inhibitor sequences

| Sequence/structure | Short-hand designation | SEQ ID NO: |
|---|---|---|
| FGLIDVKCFASSECWTACKKVTGSGQGKCQNNQCRCY | MartenTx | 35 |
| FGLIDVXCFASSECWTACKKVTCSGQGKCQNNQCRCY | MartenTx-X7 | 399 |
| FGLIDVACFASSECWTACKKVTGSGQGKCQNNQCRCY | MartenTx-A7 | 400 |
| FGLIDVKCFASSECWTACXKVTGSGQGKCQNNQCRCY | MartenTx-X19 | 401 |
| FGLIDVKCFASSECWTACAKVTGSGQGKCQNNQCRCY | MartenTx-A19 | 402 |
| FGLIDVKCFASSECWTACKXVTGSGQGKCQNNQCRCY | MartenTx-X20 | 403 |
| FGLIDVKCFASSECWTACKAVTGSGQGKCQNNQCRCY | MartenTx-A20 | 404 |

TABLE 20-continued

Martentoxin peptide and peptide analog inhibitor sequences

| Sequence/structure | Short-hand designation | SEQ ID NO: |
|---|---|---|
| FGLIDVKCFASSECWTACKKVTGSGQGXCQNNQCRCY | MartenTx-X28 | 405 |
| FGLIDVKCFASSECWTACKKVTGSGQGACQNNQCRCY | MartenTx-A28 | 406 |
| FGLIDVKCFASSECWTACKKVTGSGQGKCQNNQCXCY | MartenTx-X35 | 407 |
| FGLIDVKCFASSECWTACKKVTGSGQGKCQNNQCACY | MartenTx-A35 | 408 |

TABLE 21

N type $Ca^{2+}$ channel inhibitor peptide sequences

| Sequence/structure | Short-hand designation | SEQ ID NO: |
|---|---|---|
| CKGKGAKCSRLMYDCCTGSCRSGKC | MVIIA | 65 |
| CKSPGSSCSPTSYNCCRSCNPYTKRCY | GVIA | 64 |
| CKSKGAKCSKLMYDCCTGSCSGTVGRC | CVIA | 409 |
| CKLKGQSCRKTSYDCCSGSCGRSGKC | SVIB | 347 |
| AEKDCIAPGAPCFGTDKPCCNPRAWCSSYANKCL | Ptu1 | 66 |
| CKGKGASCRKTMYDCCRGSCRSGRC | CVIB | 1364 |
| CKGKGQSCSKLMYDCCTGSCSRRGKC | CVIC | 1365 |
| CKSKGAKCSKLMYDCCSGSCSGTVGRC | CVID | 1366 |
| CLSXGSSCSXTSYNCCRSCNXYSRKCY | TVIA | 1367 |

TABLE 22

ωOMVIIA peptide and peptide analog inhibitor sequences

| Sequence/structure | Short-hand designation | SEQ ID NO: |
|---|---|---|
| CKGKGAKCSRLMYDCCTGSCRSGKC | MVIIA | 65 |
| CXGKGAKCSRLMYDCCTGSCRSGKC | MVIIA-X2 | 410 |
| CAGKGAKCSRLMYDCCTGSCRSGKC | MVIIA-A2 | 411 |
| CKGXGAKCSRLMYDCCTGSCRSGKC | MVIIA-X4 | 412 |
| CKGAGAKCSRLMYDCCTGSCRSGKC | MVIIA-A4 | 413 |
| CKGKGAXCSRLMYDCCTGSCRSGKC | MVIIA-X7 | 414 |
| CKGKGAACSRLMYDCCTGSCRSGKC | MVIIA-A7 | 415 |
| CKGKGAKCSXLMYDCCTGSCRSGKC | MVIIA-X10 | 416 |
| CKGKGAKCSALMYDCCTGSCRSGKC | MVIIA-A10 | 417 |
| CKGKGAKCSRLMYDCCTGSCXSGKC | MVIIA-X21 | 418 |

TABLE 22-continued

ωOMVIIA peptide and peptide analog inhibitor sequences

| Sequence/structure | Short-hand designation | SEQ ID NO: |
|---|---|---|
| CKGKGAKCSRLMYDCCTGSCASGKC | MVIIA-A21 | 419 |
| CKGKGAKCSRLMYDCCTGSCRSGXC | MVIIA-X24 | 420 |
| CKGKGAKCSRLMYDCCTGSCRSGAC | MVIIA-A24 | 421 |

TABLE 23

ωGVIA peptide and peptide analog inhibitor sequences

| Sequence/structure | Short-hand designation | SEQ ID NO: |
|---|---|---|
| CKSPGSSCSPTSYNCCRSCNPYTKRCY | GVIA | 64 |
| CXSPGSSCSPTSYNCCRSCNPYTKRCY | GVIA-X2 | 422 |
| CASPGSSCSPTSYNCCRSCNPYTKRCY | GVIA-A2 | 423 |
| CKSPGSSCSPTSYNCCXSCNPYTKRCY | GVIA-X17 | 424 |
| CKSPGSSCSPTSYNCCASCNPYTKRCY | GVIA-A17 | 425 |
| CKSPGSSCSPTSYNCCRSCNPYTXRCY | GVIA-X24 | 426 |
| CKSPGSSCSPTSYNCCRSCNPYTARCY | GVIA-A24 | 427 |
| CKSPGSSCSPTSYNCCRSCNPYTKXCY | GVIA-X25 | 428 |
| CKSPGSSCSPTSYNCCRSCNPYTKACY | GVIA-A25 | 429 |

TABLE 24

Ptu1 peptide and peptide analog inhibitor sequences

| Sequence/structure | Short-hand designation | SEQ ID NO: |
|---|---|---|
| AEKDCIAPGAPCFGTDKPCCNPRAWCSSYANKCL | Ptu1 | 66 |
| AEXDCIAPGAPCFGTDKPCCNPRAWCSSYANKCL | Ptu1-X3 | 430 |
| AEADCIAPGAPCFGTDKPCCNPRAWCSSYANKCL | Ptu1-A3 | 431 |
| AEKDCIAPCAPCFGTDXPCCNPRAWCSSYANKCL | Ptu1-X17 | 432 |
| AEKDCIAPGAPCFGTDAPCCNPRAWCSSYANKCL | Ptu1-A17 | 433 |
| AEKDCIAPGAPCFGTDKPCCNPXAWCSSYANKCL | Ptu1-X23 | 434 |
| AEKDCIAPGAPCFGTDKPCCNPAAWCSSYANKCL | Ptu1-A23 | 435 |
| AEKDCIAPGAPCFGTDKPCCNPRAWCSSYANXCL | Ptu1-X32 | 436 |
| AEKDCIAPGAPCFGTDKPCCNPRAWCSSYANACL | Ptu1-A32 | 437 |

TABLE 25

*Thrixopelma pruriens* (ProTx1) and ProTx1 peptide analogs and other T type $Ca^{2+}$ channel inhibitor peptide sequences

| Sequence/structure | Short-hand designation | SEQ ID NO: |
|---|---|---|
| ECRYWLGGCSAGQTCCKHLVCSRRHGWCVWDGTFS | ProTx1 | 56 |
| ECXYWLGGCSAGQTCCKHLVCSRRHGWCVWDGTFS | ProTx1-X3 | 438 |
| ECAYWLGGCSAGQTCCKHLVCSRRHGWCVWDGTFS | ProTx1-A3 | 439 |
| ECRYWLGGCSAGQTCCXHLVCSRRHGWCVWDGTFS | ProTx1-X17 | 440 |
| ECRYWLGGCSAGQTCCAHLVCSRRHGWCVWDGTFS | ProTx1-A17 | 441 |
| ECRYWLGGCSAGQTCCKHLVCSXRHGWCVWDGTFS | ProTx1-X23 | 442 |
| ECRYWLGGCSAGQTCCKHLVCSARHGWCVWDGTFS | ProTx1-A23 | 443 |
| ECRYWLGGCSAGQTCCKHLVCSRXHGWCVWDGTFS | ProTx1-X24 | 444 |
| ECRYWLGGCSAGQTCCKHLVCSRAHGWCVWDGTFS | ProTx1-A24 | 445 |
| KIDGYPVDYW NCKRICWYNN KYCNDLCKGL KADSGYCWGW TLSCYCQGLP DNARIKRSGR CRA | Kurtoxin | 1276 |

TABLE 26

BeKM1 M current inhibitor peptide and BeKM1 peptide analog sequences

| Sequence/structure | Short-hand designation | SEQ ID NO: |
|---|---|---|
| RPTDIKCSESYQCFPVCKSRFGKTNGRCVNGFCDCF | BeKM1 | 63 |
| PTDIKCSESYQCFPVCKSRFGKTNGRCVNGFCDCF | BeKM1-d1 | 446 |
| XPTDIKCSESYQCFPVCKSRFGKTNGRCVNGFCDCF | BeKM1-X1 | 447 |
| APTDIKCSESYQCFPVCKSRFGKTNGRCVNGFCDCF | BeKM1-A1 | 448 |
| RPTDIXCSESYQCFPVCKSRFGKTNGRCVNGFCDCF | BeKM1-X6 | 449 |
| RPTDIACSESYQCFPVCKSRFGKTNGRCVNGFCDCF | BeKM1-A6 | 450 |
| RPTDIKCSESYQCFPVCXSRFGKTNCRCVNGFCDCF | BeKM1-X18 | 451 |
| RPTDIKCSESYQCFPVCASRFGKTNGRCVNGFCDCF | BeKM1-A18 | 452 |
| RPTDIKCSESYQCFPVCKSXFGKTNGRCVNGFCDCF | BeKM1-X20 | 453 |
| RPTDIKCSESYQCFPVCKSAFGKTNGRCVNGFCDCF | BeKM1-A20 | 454 |
| RPTDIKCSESYQCFPVCKSRFGXTNGRCVNGFCDCF | BeKM1-X23 | 455 |
| RPTDIKCSESYQCFPVCKSRFGATNGRCVNGFCDCF | BeKM1-A23 | 456 |
| RPTDIKCSESYQCFPVCKSRFGKTNGXCVNGFCDCF | BeKM1-X27 | 457 |
| RPTDIKCSESYQCFPVCKSRFGKTNGACVNGFCDCF | BeKM1-A27 | 458 |

TABLE 27

Na+ channel inhibitor peptide sequences

| Sequence/structure | Short-hand designation | SEQ ID NO: |
|---|---|---|
| QRCCNGRRGCSSRWCRDHSRCC | SmIIIa | 459 |
| RDCCTOOKKCKDRQCKOQRCCA | μ-GIIIA | 460 |
| RDCCTOORKCKDRRCKOMRCCA | μ-GIIIB | 461 |
| ZRLCCGFOKSCRSRQCKOHRCC | μ-PIIIA | 462 |
| ZRCCNGRRGCSSRWCRDHSRCC | μ-SmIIIA | 463 |
| ACRKKWEYCIVPIIGFIYCCPGLICGPFVCV | μO-MrVIA | 464 |
| ACSKKWEYCIVPIIGFIYCCPGLICGPFVCV | μO-MrVIB | 465 |
| EACYAOGTFCGIKOGLCCSEFCLPGVCFG | δ-PVIA | 466 |
| DGCSSGGTFCGIHOGLCCSEFCFLWCITFID | δ-SVIE | 467 |
| WCKQSGEMCNLLDQNCGDGYCIVLVCT | δ-TxVIA | 468 |
| VKPCRKEGQLCDPIFQNCCRGWNCVLFCV | δ-GmVIA | 469 |

TABLE 28

Cl- channel inhibitor peptide sequences

| Sequence/structure | Short-hand designation | SEQ ID NO: |
|---|---|---|
| MCMPCFTTDHQMARKCDDCCGGKGRGKCYGPQCLCR | CTX | 67 |
| MCMPCFTTDHQMAXKCDDCCGGKGRGKCYGPQCLCR | CTX-X14 | 470 |
| MCMPCFTTDHQMAAKCDDCCGGKGRGKCYGPQCLCR | CTX-A14 | 471 |
| MCMPCFTTDHQMARXCDDCCGGKGRGKCYGPQCLCR | CTX-X15 | 472 |
| MCMPCFTTDHQMARACDDCCGGKGRGKCYGPQCLCR | CTX-A15 | 473 |
| MCMPCFTTDHQMARKCDDCCGGXGRGKCYGPQCLCR | CTX-X23 | 474 |
| MCMPCFTTDHQMARKCDDCCGGAGRGKCYGPQCLCR | CTX-A23 | 475 |
| MCMPCFTTDHQMARKCDDCCGGKGXGKCYGPQCLCR | CTX-X25 | 476 |
| MCMPCFTTDHQMARKCDDCCGGKGAGKCYGPQCLCR | CTX-A25 | 477 |
| MCMPCFTTDHQMARKCDDCCGGKGRGXCYGPQCLCR | CTX-X27 | 478 |
| MCMPCFTTDHQMARKCDDCCGGKGRGACYGPQCLCR | CTX-A27 | 479 |
| MCMPCFTTDHQMARKCDDCCGGKGRGKCYGPQCLCX | CTX-X36 | 480 |
| MCMPCFTTDHQMARKCDDCCGGKGRGKCYGPQCLCA | CTX-A36 | 481 |
| MCMPCFTTDHQMARKCDDCCGGKGRGKCYGPQCLC | CTX-d36 | 482 |

TABLE 28-continued

Cl- channel inhibitor peptide sequences

| Sequence/structure | Short-hand designation | SEQ ID NO: |
|---|---|---|
| QTDGCGPCFTTDANMARKCRECCGGNGKCFGPQCLCNRE | Bm-12b | 483 |
| QTDGCGPCFTTDANMAXKCRECCGGNGKCFGPQCLCNRE | Bm-12b-X17 | 484 |
| QTDGCGPCFTTDANMAAKCRECCGGNGKCFGPQCLCNRE | Bm-12b-A17 | 485 |
| QTDGCGPCFTTDANMARXCRECCGGNGKCFGPQCLCNRE | Bm-12b-X18 | 486 |
| QTDGCGPCFTTDANMARACRECCGGNGKCFGPQCLCNRE | Bm-12b-A18 | 487 |
| QTDGCGPCFTTDANMARKCXECCGGNGKCFGPQCLCNRE | Bm-12b-X20 | 488 |
| QTDGCGPCFTTDANMARKCAECCGGNGKCFGPQCLCNRE | Bm-12b-A20 | 489 |
| QTDGCGPCFTTDANMARKCRECCGGNGXCFGPQCLCNRE | Bm-12b-X28 | 490 |
| QTDGCGPCFTTDANMARKCRECCGGNGACFGPQCLCNRE | Bm-12b-A28 | 491 |
| QTDGCGPCFTTDANMARKCRECCGGNGKCFGPQCLCNXE | Bm-12b-X38 | 492 |
| QTDGCGPCFTTDANMARKCRECCGGNGKCFGPQCLCNAE | Bm-12b-A38 | 493 |

TABLE 29

| Kv2.1 inhibitor peptide sequences | | |
|---|---|---|
| Sequence/structure | Short-hand designation | SEQ ID NO: |
| ECRYLFGGCKTTSDCCKHLGCKFRDKYCAWDFTFS | HaTx1 | 494 |
| ECXYLFGGCKTTSDCCKHLGCKFRDKYCAWDFTFS | HaTx1-X3 | 495 |
| ECAYLFGGCKTTSDCCKHLGCKFRDKYCAWDFTFS | HaTx1-A3 | 496 |
| ECRYLFGGCXTTSDCCKHLGCKFRDKYCAWDFTFS | HaTx1-X10 | 497 |
| ECRYLFGGCATTSDCCKHLGCKFRDKYCAWDFTFS | HaTx1-A10 | 498 |
| ECRYLFGGCKTTSDCCXHLGCKFRDKYCAWDFTFS | HaTx1-X17 | 499 |
| ECRYLFGGCKTTSDCCAHLGCKFRDKYCAWDFTFS | HaTx1-A17 | 500 |
| ECRYLFGGCKTTSDCCKHLGCXFRDKYCAWDFTFS | HaTx1-X22 | 501 |
| ECRYLFGGCKTTSDCCKHLGCAFRDKYCAWDFTFS | HaTx1-A22 | 502 |

TABLE 29-continued

Kv2.1 inhibitor peptide sequences

| Sequence/structure | Short-hand designation | SEQ ID NO: |
|---|---|---|
| ECRYLFGGCKTTSDCCKHLGCKFXDKYCAWDFTFS | HaTx1-X24 | 503 |
| ECRYLFGGCKTTSDCCKHLGCKFADKYCAWDFTFS | HaTx1-A24 | 504 |
| ECRYLFGGCKTTSDCCKHLGCKFRDXYCAWDFTFS | HaTx1-X26 | 505 |
| ECRYLFGGCKTTSDCCKHLGCKFRDAYCAWDFTFS | HaTx1-A26 | 506 |

TABLE 30

Kv4.3 & Kv4.2 inhibitor peptide sequences

| Sequence/structure | Short-hand designation | SEQ ID NO: |
|---|---|---|
| YCQKWMWTCDEERKCCEGLVCRLWCKRIINM | PaTx2 | 57 |
| YCQXWMWTCDEERKCCEGLVCRLWCKRIINM | PaTx2-X4 | 507 |
| YCQAWMWTCDEERKCCEGLVCRLWCKRIINM | PaTx2-A4 | 508 |
| YCQKWMWTCDEEXKCCEGLVCRLWCKRIINM | PaTx2-X13 | 509 |
| YCQKWMWTCDEEAKCCEGLVCRLWCKRIINM | PaTx2-A13 | 510 |
| YCQKWMWTCDEERXCCEGLVCRLWCKRIINM | PaTx2-X14 | 511 |
| YCQKWMWTCDEERACCEGLVCRLWCKRIINM | PaTx2-A14 | 512 |
| YCQKWMWTCDEERKCCEGLVCXLWCKRIINM | PaTx2-X22 | 513 |
| YCQKWMWTCDEERKCCEGLVCALWCKRIINM | PaTx2-A22 | 514 |
| YCQKWMWTCDEERKCCEGLVCRLWCXRIINM | PaTx2-X26 | 515 |
| YCQKWMWTCDEERKCCEGLVCRLWCARIINM | PaTx2-A26 | 516 |
| YCQKWMWTCDEERKCCEGLVCRLWCKXIINM | PaTx2-X27 | 517 |
| YCQKWMWTCDEERKCCEGLVCRLWCKAIINM | PaTx2-A27 | 518 |

TABLE 31 nACHR channel inhibitor peptide sequences

| Sequence/structure | Short-hand designation | SEQ ID NO: |
|---|---|---|
| GCCSLPPCAANNPDYC | PnIA | 519 |
| GCCSLPPCALNNPDYC | PnIA-L10 | 520 |
| GCCSLPPCAASNPDYC | PnIA-S11 | 521 |
| GCCSLPPCALSNPDYC | PnIB | 522 |
| GCCSLPPCAASNPDYC | PnIB-A10 | 523 |
| GCCSLPPCALNNPDYC | PnIB-N11 | 524 |
| GCCSNPVCHLEHSNLC | MII | 525 |
| GRCCHPACGKNYSC | α-MI | 526 |
| RD(hydroxypro)CCYHPTCNMSNPQIC | α-EI | 527 |
| GCCSYPPCFATNPDC | α-AuIB | 528 |
| RDPCCSNPVCTVHNPQIC | α-PIA | 529 |
| GCCSDPRCAWRC | α-Iml | 530 |
| ACCSDRRCRWRC | α-ImII | 531 |
| ECCNPACGRHYSC | α-GI | 532 |
| GCCGSY(hydroxypro)NAACH(hydroxypro)CSCKDR(hydroxypro)SYCGQ | αA-PIVA | 533 |
| GCCPY(hydroxypro)NAACH(hydroxypro)CGCKVGR(hydroxypro)(hydroxypra)YCDR(hydroxypro)SGG | αA-EIVA | 534 |
| H(hydroxypro)(hydroxypro)CCLYGKCRRY(hydroxypro)GCSSASCCQR | ψ-PIIIE | 535 |
| GCCSDPRCNMNNPDYC | EpI | 536 |
| GCCSHPACAGNNQHIC | GIC | 537 |
| IRD(γ-carboxyglu)CCSNPACRVNN(hydroxypro)HVC | GID | 538 |
| GGCCSHPACAANNQDYC | AnIB | 539 |
| GCCSYPPCFATNSDYC | AuIA | 540 |
| GCCSYPPCFATNSGYC | AuIC | 541 |

TABLE 32

*Agelenopsis aperta* (Agatoxin) toxin peptides and peptide analogs and other $Ca^{2+}$ channel inhibiter peptides

| Sequence/structure | Short-hand designation | SEQ ID NO: |
|---|---|---|
| KKKCIAKDYG RCKWGGTPCC RGRGCICSIM GTNCECKPRL IMEGLGLA | ω-Aga-IVA | 959 |
| EDNCIAEDYG KCTWGGTKCC RGRPCRCSMI GTNCECTPRL IMEGLSFA | ω-Aga-IVB | 960 |

TABLE 32-continued

*Agelenopsis aperta* (Agatoxin) toxin peptides and peptide analogs and other $Ca^{2+}$ channel inhibiter peptides

| Sequence/structure | Short-hand designation | SEQ ID NO: |
|---|---|---|
| SCIDIGGDCD GEKDDCQCCR RNGYCSCYSL FGYLKSGCKC VVGTSAEFQG ICRRKARQCY NSDPDKCESH NKPKRR | ω-Aga-IIIA | 961 |
| SCIDIGGDCD GEKDDCQCCR RNGYCSCYSL FGYLKSGCKC VVGTSAEFQG ICRRKARTCY NSDPDKCESH NKPKRR | ω-Aga-IIIA-T58 | 962 |
| SCIDFGGDCD GEKDDCQCCR SNGYCSCYSL FGYLKSGCKC EVGTSAEFRR ICRRKAKQCY NSDPDKCVSV YKPKRR | ω-Aga-IIIB | 963 |
| SCIDFGGDCD GEKDDCQCCR SNGYCSCYNL FGYLKSGCKC EVGTSAEFRR ICRRKAKQCYNSDPDKCVSV YKPKRR | ω-Aga-IIIB-N29 | 964 |
| SCIDFGGDCD GEKDDCQCCR SNGYCSCYNL FGYLRSGCKC EVGTSAEFRR ICRRKAKQCY NSDPDKCVSV YKPKRR | ω-Aga-IIIB-N29/R35 | 965 |
| NCIDFGGDCD GEKDDCQCCR RNGYCSCYNL FGYLKRGCKX EVG | ω-Aga-IIIC | 966 |
| SCIKIGEDCD GDKDDCQCCR TNGYCSXYXL FGYLKSG | ω-Aga-IIID | 967 |
| GCIEIGGDCD GYQEKSYCQC CRNNGFCS | ω-Aga-IIA | 968 |
| AKAL PPGSVCDGNE SDCKCYGKWH KCRCPWKWHF TGEGPCTCEK GMKHTCITKL HCPNKAEWGL DW | ω-Aga-IA (major chain) | 969 |
| ECVPENGHCR DWYDECCEGF YCSCRQPPKC ICRNNNX | μ-Aga | 970 |
| DCVGESQQCA DWAGPHCCDG YYCTCRYFPK CICVNNN | μ-Aga-6 | 971 |
| ACVGENKQCA DWAGPHCCDG YYCTCRYFPK CICRNNN | μ-Aga-5 | 972 |
| ACVGENQQCA DWAGPHCCDG YYCTCRYFPK CICRNNN | μ-Aga-4 | 973 |
| ADCVGDGQRC ADWAGPYCCS GYYCSCRSMP YCRCRSDS | μ-Aga-3 | 1275 |
| ECATKNKRCA DWAGPWCCDG LYCSCRSYPG CMCRPSS | μ-Aga-2 | 974 |
| ECVPENGHCR DWYDECCEGF YCSCRQPPKC ICRNNN | μ-Aga-1 | 975 |
| AELTSCFPVGHECDGDASNCNCCGDDVYCGCGWGRWNCKC KVADQSYAYGICKDKVNCPNRHLWPAKVCKKPCRREC | Tx-1 | 1277 |
| GCANAYKSCNGPHTCCWGYNGYKKACICSGXNWK | Tx3-3 | 1278 |
| SCINVGDFCDGKKDCCQCDRDNAFCSCSVIFGYKTNCRCE | Tx3-4 | 1279 |
| SCINVGDFCDGKKDDCQCCRDNAFCSCSVIFGYKTNCRCE VGTTATSYGICMAKHKCGRQTTCTKPCLSKRCKKNH | ω-PtXIIA | 1280 |
| AECLMIGDTSCVPRLGRRCCYGAWCYCDQQLSCRRVGRKR ECGWVEVNCKCGWSWSQRIDDWRADYSCKCPEDQ | Dw13.3 | 1281 |
| GGCLPHNRFCNALSGPRCCSGLKCKELSIWDSRCL | Agelenin | 1282 |
| DCVRFWGKCSQTSDCCPHLACKSKWPRNICVWDGSV | ω-GTx-SIA | 1283 |
| GCLEVDYFCG IPFANNGLCC SGNCVFVCTP Q | ω-conotoxin PnVIA | 1284 |
| DDDCEPPGNF CGMIKIGPPC CSGWCFFACA | ω-conotoxin PnVIB | 1285 |
| VCCGYKLCHP C | Lambda-conotoxin CMrVIA | 1286 |

TABLE 32-continued

| *Agelenopsis aperta* (Agatoxin) toxin peptides and peptide analogs and other $Ca^{2+}$ channel inhibiter peptides | | |
|---|---|---|
| Sequence/structure | Short-hand designation | SEQ ID NO: |
| MRCLPVLIIL LLLTASAPGV VVLPKTEDDV PMSSVYGNGK SILRGILRNG VCCGYKLCHP C | Lambda-conotoxin CMrVIB | 1287 |
| KIDGYPVDYW NCKRICWYNN KYCNDLCKGL KADSGYCWGW TLSCYCQGLP DNARIKRSGR CRA | Kurtoxin | 1276 |
| CKGKGAPCRKTMYDCCSGSCGRRGKC | MVIIC | 1368 |

In accordance with this invention are molecules in which at least one of the toxin peptide (P) portions of the molecule comprises a Kv1.3 antagonist peptide. Amino acid sequences selected from ShK, HmK, MgTx, AgTx1, AgTx2, Heterometrus spinnifer (HsTx1), OSK1, Anuroctoxin (AnTx), Noxiustoxin (NTX), KTX1, Hongotoxin, ChTx, Titystoxin, BgK, BmKTX, BmTx, AeK, AsKS Tc30, Tc32, Pi1, Pi2, and/or Pi3 toxin peptides and peptide analogs of any of these are preferred. Examples of useful Kv1.3 antagonist peptide sequences include those having any amino acid sequence set forth in Table 1, Table 2, Table 3, Table 4, Table 5, Table 6, Table 7, Table 8, Table 9, Table 10, and/or Table 11 herein above;

Other embodiments of the inventive composition include at least one toxin peptide (P) that is an IKCa1 antagonist peptide. Useful IKCa1 antagonist peptides include Maurotoxin (MTx), ChTx, peptides and peptide analogs of either of these, examples of which include those having any amino acid sequence set forth in Table 12, Table 13, and/or Table 14;

Other embodiments of the inventive composition include at least one toxin peptide (P) that is a SKCa inhibitor peptide. Useful SKCa inhibitor peptides include, Apamin, ScyTx, BmP05, P01, P05, Tamapin, TsK, and peptide analogs of any of these, examples of which include those having any amino acid sequence set forth in Table 15;

Other embodiments of the inventive composition include at least one toxin peptide (P) that is an apamin peptide, and peptide analogs of apamin, examples of which include those having any amino acid sequence set forth in Table 16;

Other embodiments of the inventive composition include at least one toxin peptide (P) that is a Scyllotoxin family peptide, and peptide analogs of any of these, examples of which include those having any amino acid sequence set forth in Table 17;

Other embodiments of the inventive composition include at least one toxin peptide (P) that is a BKCa inhibitor peptide, examples of which include those having any amino acid sequence set forth in Table 18;

Other embodiments of the inventive composition include at least one toxin peptide (P) that is a Slotoxin family peptide, and peptide analogs of any of these, examples of which include those having any amino acid sequence set forth in Table 19;

Other embodiments of the inventive composition include at least one toxin peptide (P) that is a Martentoxin peptide, and peptide analogs thereof, examples of which include those having any amino acid sequence set forth in Table 20;

Other embodiments of the inventive composition include at least one toxin peptide (P) that is a N-type $Ca^{2+}$ channel inhibitor peptide, examples of which include those having any amino acid sequence set forth in Table 21;

Other embodiments of the inventive composition include at least one toxin peptide (P) that is a ωMVIIA peptide, and peptide analogs thereof, examples of which include those having any amino acid sequence set forth in Table 22;

Other embodiments of the inventive composition include at least one toxin peptide (P) that is a ωGVIA peptide, and peptide analogs thereof, examples of which include those having any amino acid sequence set forth in Table 23;

Other embodiments of the inventive composition include at least one toxin peptide (P) that is a Ptu1 peptide, and peptide analogs thereof, examples of which include those having any amino acid sequence set forth in Table 24;

Other embodiments of the inventive composition include at least one toxin peptide (P) that is a ProTx1 peptide, and peptide analogs thereof, examples of which include those having any amino acid sequence set forth in Table 25;

Other embodiments of the inventive composition include at least one toxin peptide (P) that is a BeKM1 peptide, and peptide analogs thereof, examples of which include those having any amino acid sequence set forth in Table 26;

Other embodiments of the inventive composition include at least one toxin peptide (P) that is a $Na^{+}$ channel inhibitor peptide, examples of which include those having any amino acid sequence set forth in Table 27;

Other embodiments of the inventive composition include at least one toxin peptide (P) that is a $Cl^{-}$ channel inhibitor peptide, examples of which include those having any amino acid sequence set forth in Table 28;

Other embodiments of the inventive composition include at least one toxin peptide (P) that is a Kv2.1 inhibitor peptide, examples of which include those having any amino acid sequence set forth in Table 29;

Other embodiments of the inventive composition include at least one toxin peptide (P) that is a Kv4.2/Kv4.3 inhibitor peptide, examples of which include those having any amino acid sequence set forth in Table 30;

Other embodiments of the inventive composition include at least one toxin peptide (P) that is a nACHR inhibitor peptide, examples of which include those having any amino acid sequence set forth in Table 31; and Other embodiments of the inventive composition include at least one toxin peptide (P) that is an Agatoxin peptide, a peptide analog thereof or other calcium channel inhibitor peptide, examples of which include those having any amino acid sequence set forth in Table 32.

Half-life Extending Moieties. This invention involves the presence of at least one half-life extending moiety ($F^1$ and/or $F^2$ in Formula I) attached to a peptide through the N-terminus, C-terminus or a sidechain of one of the intracalary amino acid residues. Multiple half-life extending moieties can also be used; e.g., Fc's at each terminus or an Fc at a terminus and a PEG group at the other terminus or at a sidechain. In other embodiments the Fc domain can be PEGylated (e.g., in accordance with the formulae $F^1$—$F^2$-(L)$_f$-P; P-(L)$_g$-$F^1$—$F^2$; or P-(L)$_g$-$F^1$—$F^2$-(L)$_f$-P).

The half-life extending moiety can be selected such that the inventive composition achieves a sufficient hydrodynamic size to prevent clearance by renal filtration in vivo. For example, a half-life extending moiety can be selected that is a polymeric macromolecule, which is substantially straight chain, branched-chain, or dendritic in form. Alternatively, a half-life extending moiety can be selected such that, in vivo, the inventive composition of matter will bind to a serum protein to form a complex, such that the complex thus formed avoids substantial renal clearance. The half-life extending moiety can be, for example, a lipid; a cholesterol group (such as a steroid); a carbohydrate or oligosaccharide; or any natural or synthetic protein, polypeptide or peptide that binds to a salvage receptor.

Exemplary half-life extending moieties that can be used, in accordance with the present invention, include an immunoglobulin Fc domain, or a portion thereof, or a biologically suitable polymer or copolymer, for example, a polyalkylene glycol compound, such as a polyethylene glycol or a polypropylene glycol. Other appropriate polyalkylene glycol compounds include, but are not limited to, charged or neutral polymers of the following types: dextran, polylysine, colominic acids or other carbohydrate based polymers, polymers of amino acids, and biotin derivatives.

Other examples of the half-life extending moiety, in accordance with the invention, include a copolymer of ethylene glycol, a copolymer of propylene glycol, a carboxymethylcellulose, a polyvinyl pyrrolidone, a poly-1,3-dioxolane, a poly-1,3,6-trioxane, an ethylene/maleic anhydride copolymer, a polyaminoacid (e.g., polylysine), a dextran n-vinyl pyrrolidone, a poly n-vinyl pyrrolidone, a propylene glycol homopolymer, a propylene oxide polymer, an ethylene oxide polymer, a polyoxyethylated polyol, a polyvinyl alcohol, a linear or branched glycosylated chain, a polyacetal, a long chain fatty acid, a long chain hydrophobic aliphatic group, an immunoglobulin Fc domain or a portion thereof (see, e.g., Feige et al., *Modified peptides as therapeutic agents*, U.S. Pat. No. 6,660,843), a CH2 domain of Fc, an albumin (e.g., human serum albumin (HSA)); see, e.g., Rosen et al., *Albumin fusion proteins*, U.S. Pat. No. 6,926,898 and US 2005/0054051; Bridon et al., *Protection of endogenous therapeutic peptides from peptidase activity through conjugation to blood components*, U.S. Pat. No. 6,887,470), a transthyretin (TTR; see, e.g., Walker et al., *Use of transthyretin peptide/protein fusions to increase the serum half-life of pharmacologically active peptides/proteins*, US 2003/0195154 A1; 2003/0191056 A1), or a thyroxine-binding globulin (TBG). Thus, exemplary embodiments of the inventive compositions also include HSA fusion constructs such as but not limited to: HSA fusions with ShK, OSK1, or modified analogs of those toxin peptides. Examples include HSA-L10-ShK(2-35); HSA-L1-OsK1(1-38); HSA-L10-ShK(2-35); and HSA-L10-OsK1(1-38).

Other embodiments of the half-life extending moiety, in accordance with the invention, include peptide ligands or small (organic) molecule ligands that have binding affinity for a long half-life serum protein under physiological conditions of temperature, pH, and ionic strength. Examples include an albumin-binding peptide or small molecule ligand, a transthyretin-binding peptide or small molecule ligand, a thyroxine-binding globulin-binding peptide or small molecule ligand, an antibody-binding peptide or small molecule ligand, or another peptide or small molecule that has an affinity for a long half-life serum protein. (See, e.g., Blaney et al., Method and compositions for increasing the serum half-life of pharmacologically active agents by binding to transthyretin-selective ligands, U.S. Pat. No. 5,714,142; Sato et al., Serum albumin binding moieties, US 2003/0069395 A1; Jones et al., Pharmaceutical active conjugates, U.S. Pat. No. 6,342,225). A "long half-life serum protein" is one of the hundreds of different proteins dissolved in mammalian blood plasma, including so-called "carrier proteins" (such as albumin, transferrin and haptoglobin), fibrinogen and other blood coagulation factors, complement components, immunoglobulins, enzyme inhibitors, precursors of substances such as angiotensin and bradykinin and many other types of proteins. The invention encompasses the use of any single species of pharmaceutically acceptable half-life extending moiety, such as, but not limited to, those described herein, or the use of a combination of two or more different half-life extending moieties, such as PEG and immunoglobulin Fc domain or a CH2 domain of Fc, albumin (e.g., HSA), an albumin-binding protein, transthyretin or TBG.

In some embodiments of the invention an Fc domain or portion thereof, such as a CH2 domain of Fc, is used as a half-life extending moiety. The Fc domain can be fused to the N-terminal (e.g., in accordance with the formula $F^1$-(L)$_f$-P) or C-terminal (e.g., in accordance with the formula P-(L)$_g$-$F^1$) of the toxin peptides or at both the N and C termini (e.g., in accordance with the formulae $F^1$-(L)$_f$-P-(L)$_g$-$F^2$ or P-(L)$_g$-$F^1$-(L)$_f$-P). A peptide linker sequence can be optionally included between the Fc domain and the toxin peptide, as described herein. Examples of the formula $F^1$-(L)$_f$-P include: Fc-L10-ShK(K22A)[2-35]; Fc-L10-ShK(R1K/K22A)[1-35]; Fc-L10-ShK(R1H/K22A)[1-35]; Fc-L10-ShK(R1Q/K22A)[1-35]; Fc-L10-ShK(R1Y/K22A)[1-35]; Fc-L10-PP-ShK(K22A)[1-35]; and any other working examples described herein. Examples of the formula P-(L)$_g$-$F^1$ include: ShK(1-35)-L10-Fc; OsK1(1-38)-L10-Fc; Met-ShK(1-35)-L10-Fc; ShK(2-35)-L10-Fc; Gly-ShK(1-35)-L10-Fc; Osk1(1-38)-L10-Fc; and any other working examples described herein.

Fc variants are suitable half-life extending moieties within the scope of this invention. A native Fc can be extensively modified to form an Fc variant in accordance with this invention, provided binding to the salvage receptor is maintained; see, for example WO 97/34631, WO 96/32478, and WO 04/110 472. In such Fc variants, one can remove one or more sites of a native Fc that provide structural features or functional activity not required by the fusion molecules of this invention. One can remove these sites by, for example, substituting or deleting residues, inserting residues into the site, or truncating portions containing the site. The inserted or substituted residues can also be altered amino acids, such as peptidomimetics or D-amino acids. Fc variants can be desirable for a number of reasons, several of which are described below. Exemplary Fc variants include molecules and sequences in which:

1. Sites involved in disulfide bond formation are removed. Such removal can avoid reaction with other cysteine-containing proteins present in the host cell used to produce the molecules of the invention. For this purpose, the cysteine-containing segment at the N-terminus can be truncated or cysteine residues can be deleted or substituted with other amino acids (e.g., alanyl, seryl). In particular, one can truncate the N-terminal 20-amino acid segment of SEQ ID NO: 2 or delete or substitute the cysteine residues at positions 7 and 10 of SEQ ID NO: 2. Even when cysteine residues are removed, the single chain Fc domains can still form a dimeric Fc domain that is held together non-covalently.
2. A native Fc is modified to make it more compatible with a selected host cell. For example, one can remove the PA sequence near the N-terminus of a typical native Fc, which can be recognized by a digestive enzyme in *E. coli* such as proline iminopeptidase. One can also add an N-terminal methionine residue, especially when the molecule is expressed recombinantly in a bacterial cell such as *E. coli*. The Fc domain of SEQ ID NO: 2 (FIG. 4) is one such Fc variant.
3. A portion of the N-terminus of a native Fc is removed to prevent N-terminal heterogeneity when expressed in a selected host cell. For this purpose, one can delete any of the first 20 amino acid residues at the N-terminus, particularly those at positions 1, 2, 3, 4 and 5.
4. One or more glycosylation sites are removed. Residues that are typically glycosylated (e.g., asparagine) can confer cytolytic response. Such residues can be deleted or substituted with unglycosylated residues (e.g., alanine).
5. Sites involved in interaction with complement, such as the C1q binding site, are removed. For example, one can delete or substitute the EKK sequence of human IgG1. Complement recruitment may not be advantageous for the molecules of this invention and so can be avoided with such an Fc variant.
6. Sites are removed that affect binding to Fc receptors other than a salvage receptor. A native Fc can have sites for interaction with certain white blood cells that are not required for the fusion molecules of the present invention and so can be removed.
7. The ADCC site is removed. ADCC sites are known in the art; see, for example, *Molec. Immunol.* 29 (5): 633-9 (1992) with regard to ADCC sites in IgG1. These sites, as well, are not required for the fusion molecules of the present invention and so can be removed.
8. When the native Fc is derived from a non-human antibody, the native Fc can be humanized. Typically, to humanize a native Fc, one will substitute selected residues in the non-human native Fc with residues that are normally found in human native Fc. Techniques for antibody humanization are well known in the art.

Preferred Fc variants include the following. In SEQ ID NO: 2, the leucine at position 15 can be substituted with glutamate; the glutamate at position 99, with alanine; and the lysines at positions 101 and 103, with alanines. In addition, phenylalanine residues can replace one or more tyrosine residues.

An alternative half-life extending moiety would be a protein, polypeptide, peptide, antibody, antibody fragment, or small molecule (e.g., a peptidomimetic compound) capable of binding to a salvage receptor. For example, one could use as a half-life extending moiety a polypeptide as described in U.S. Pat. No. 5,739,277, issued Apr. 14, 1998 to Presta et al. Peptides could also be selected by phage display for binding to the FcRn salvage receptor. Such salvage receptor-binding compounds are also included within the meaning of "half-life extending moiety" and are within the scope of this invention. Such half-life extending moieties should be selected for increased half-life (e.g., by avoiding sequences recognized by proteases) and decreased immunogenicity (e.g., by favoring non-immunogenic sequences, as discovered in antibody humanization).

As noted above, polymer half-life extending moieties can also be used for $F^1$ and $F^2$. Various means for attaching chemical moieties useful as half-life extending moieties are currently available, see, e.g., Patent Cooperation Treaty ("PCT") International Publication No. WO 96/11953, entitled "N-Terminally Chemically Modified Protein Compositions and Methods," herein incorporated by reference in its entirety. This PCT publication discloses, among other things, the selective attachment of water-soluble polymers to the N-terminus of proteins.

In some embodiments of the inventive compositions, the polymer half-life extending moiety is polyethylene glycol (PEG), as $F^1$ and/or $F^2$, but it should be understood that the inventive composition of matter, beyond positions $F^1$ and/or $F^2$, can also include one or more PEGs conjugated at other sites in the molecule, such as at one or more sites on the toxin peptide. Accordingly, some embodiments of the inventive composition of matter further include one or more PEG moieties conjugated to a non-PEG half-life extending moiety, which is $F^1$ and/or $F^2$, or to the toxin peptide(s) (P), or to any combination of any of these. For example, an Fc domain or portion thereof (as F1 and/or F2) in the inventive composition can be made mono-PEGylated, di-PEGylated, or otherwise multi-PEGylated, by the process of reductive alkylation.

Covalent conjugation of proteins and peptides with poly (ethylene glycol) (PEG) has been widely recognized as an approach to significantly extend the in vivo circulating half-lives of therapeutic proteins. PEGylation achieves this effect predominately by retarding renal clearance, since the PEG moiety adds considerable hydrodynamic radius to the protein. (Zalipsky, S., et al., Use of functionalized poly(ethylene glycol)s for modification of polypeptides., in poly(ethylene glycol) chemistry: Biotechnical and biomedical applications., J. M. Harris, Ed., Plenum Press: New York., 347-370 (1992)). Additional benefits often conferred by PEGylation of proteins and peptides include increased solubility, resistance to proteolytic degradation, and reduced immunogenicity of the therapeutic polypeptide. The merits of protein PEGylation are evidenced by the commercialization of several PEGylated proteins including PEG-Adenosine deaminase (Adagen™/Enzon Corp.), PEG-L-asparaginase (Oncaspar™/Enzon Corp.), PEG-Interferon α-2b (PEG-Intron™/Schering/Enzon), PEG-Interferon α-2a (PEGASYS™/Roche) and PEG-G-CSF (Neulasta™/Amgen) as well as many others in clinical trials. It Briefly, the PEG groups are generally attached to the peptide portion of the composition of the invention via acylation or reductive alkylation through a reactive group on the PEG moiety (e.g., an aldehyde, amino, thiol, or ester group) to a reactive group on the inventive compound (e.g., an aldehyde, amino, or ester group).

Figure 5A:
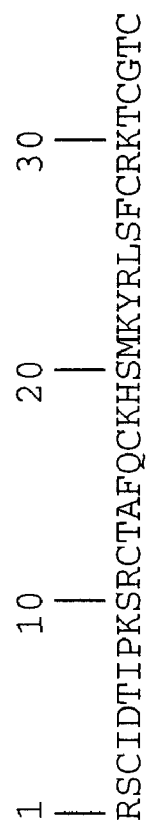
FIG. 5A shows the amino acid sequence of the mature ShK peptide (SEQ ID NO: 5), which can be encoded for by a nucleic acid sequence containing codons optimized for expression in mammalian cell, bacteria or yeast.
Figure 5B:
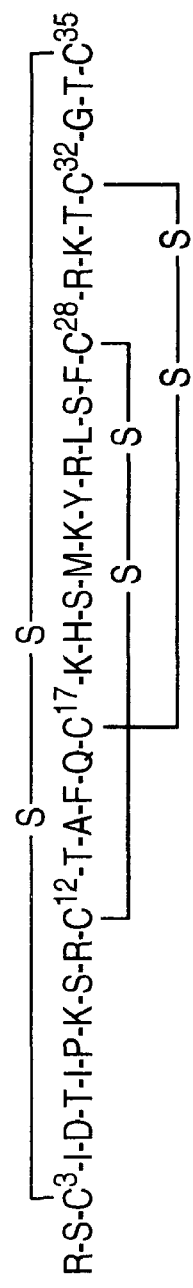
FIG. 5B shows the three disulfide bonds (—S—S—) formed by the six cysteines within the ShK peptide (SEQ ID NO: 10).
Figure 10:
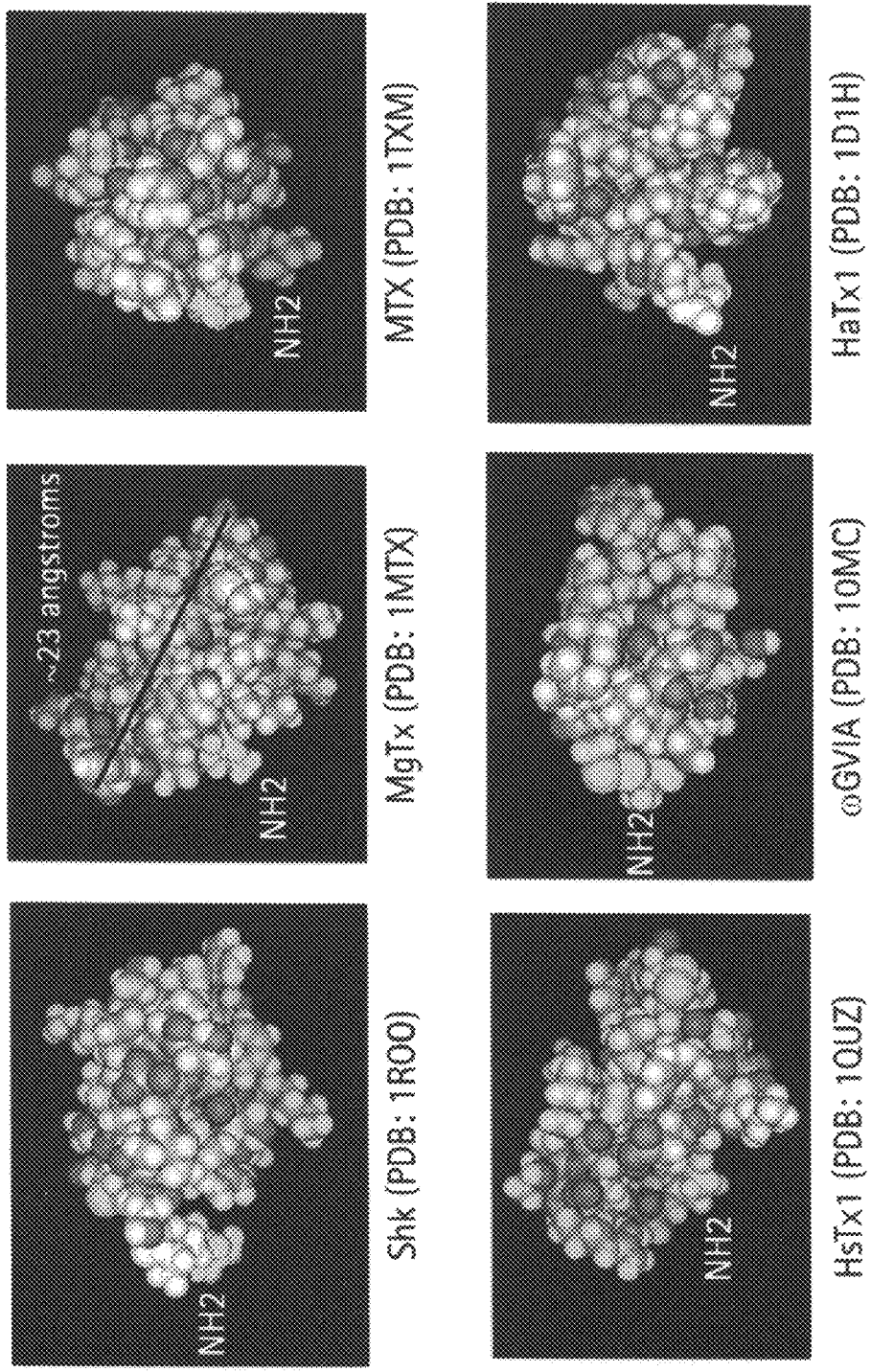
FIG. 10 illustrates that solution structures of toxins reveal a compact structure. Solution structures of native toxins from sea anemone (ShK), scorpion (MgTx, MTX, HsTx1), marine cone snail (wGVIA) and tarantula (HaTx1) indicate the 28 to 39 amino acid peptides all form a compact structure. The toxins shown have 3 or 4 disulfide linkages and fall within 4 of the 6 subfamilies shown in FIG. 9. The solution structures of native toxins from sea anemone (ShK), scorpion (MgTx, MTX, HsTx1), marine cone snail (wGVIA) and tarantula (HaTx1) were derived from Protein Data Bank (PDB) accession numbers 1ROO (mmdbld:5247), 1MTX (mmdbld:4064), 1TXM (mmdbld:6201), 1QUZ (mmdbld:36904), 1OMZ (mmdbld:1816) and 1D1H (mmdbld:14344) using the MMDB Entrez 3D-structure database [J. Chen et al. (2003) *Nucleic Acids Res.* 31, 474] and viewer.

A useful strategy for the PEGylation of synthetic peptides consists of combining, through forming a conjugate linkage in solution, a peptide and a PEG moiety, each bearing a special functionality that is mutually reactive toward the other. The peptides can be easily prepared with conventional solid phase synthesis (see, for example, FIGS. 5 and 6 and the accompanying text herein). The peptides are "preactivated" with an appropriate functional group at a specific site. The precursors are purified and fully characterized prior to reacting with the PEG moiety. Ligation of the peptide with PEG usually takes place in aqueous phase and can be easily monitored by reverse phase analytical HPLC. The PEGylated peptides can be easily purified by preparative HPLC and characterized by analytical HPLC, amino acid analysis and laser desorption mass spectrometry.

PEG is a well-known, water soluble polymer that is commercially available or can be prepared by ring-opening polymerization of ethylene glycol according to methods well known in the art (Sandler and Karo, Polymer Synthesis, Academic Press, New York, Vol. 3, pages 138-161). In the present application, the term "PEG" is used broadly to encompass any polyethylene glycol molecule, in mono-, bi-, or polyfunctional form, without regard to size or to modification at an end of the PEG, and can be represented by the formula:

$$X\text{—}O(CH_2CH_2O)_{n-1}CH_2CH_2OH, \quad (X)$$

where n is 20 to 2300 and X is H or a terminal modification, e.g., a $C_{1-4}$ alkyl.

In some useful embodiments, a PEG used in the invention terminates on one end with hydroxy or methoxy, i.e., X is H or $CH_3$ ("methoxy PEG"). It is noted that the other end of the PEG, which is shown in formula (II) terminating in OH, covalently attaches to an activating moiety via an ether oxygen bond, an amine linkage, or amide linkage. When used in a chemical structure, the term "PEG" includes the formula (II) above without the hydrogen of the hydroxyl group shown, leaving the oxygen available to react with a free carbon atom of a linker to form an ether bond. More specifically, in order to conjugate PEG to a peptide, the peptide must be reacted with PEG in an "activated" form. Activated PEG can be represented by the formula:

$$(PEG)\text{-}(A) \quad (XI)$$

where PEG (defined supra) covalently attaches to a carbon atom of the activation moiety (A) to form an ether bond, an amine linkage, or amide linkage, and (A) contains a reactive group which can react with an amino, imino, or thiol group on an amino acid residue of a peptide or a linker moiety covalently attached to the peptide.

Techniques for the preparation of activated PEG and its conjugation to biologically active peptides are well known in the art. (E.g., see U.S. Pat. Nos. 5,643,575, 5,919,455, 5,932, 462, and 5,990,237; Thompson et al., PEGylation of polypeptides, EP 0575545 B1; Petit, Site specific protein modification, U.S. Pat. Nos. 6,451,986, and 6,548,644; S. Herman et al., Poly(ethylene glycol) with reactive endgroups: I. Modification of proteins, J. Bioactive Compatible Polymers, 10:145-187 (1995); Y. Lu et al., Pegylated peptides III: Solid-phase synthesis with PEGylating reagents of varying molecular weight: synthesis of multiply PEGylated peptides, Reactive Polymers, 22:221-229 (1994); A. M. Felix et al., PEGylated Peptides IV: Enhanced biological activity of site-directed PEGylated GRF analogs, Int. J. Peptide Protein Res., 46:253-264 (1995); A. M. Felix, Site-specific poly(ethylene glycol)ylation of peptides, ACS Symposium Series 680(poly (ethylene glycol)): 218-238 (1997); Y. Ikeda et al., Polyethylene glycol derivatives, their modified peptides, methods for producing them and use of the modified peptides, EP 0473084 B1; G. E. Means et al., Selected techniques for the modification of protein side chains, in: Chemical modification of proteins, Holden Day, Inc., 219 (1971)).

Activated PEG, such as PEG-aldehydes or PEG-aldehyde hydrates, can be chemically synthesized by known means or obtained from commercial sources, e.g., Shearwater Polymers, (Huntsville, Ala.) or Enzon, Inc. (Piscataway, N.J.).

An example of a useful activated PEG for purposes of the present invention is a PEG-aldehyde compound (e.g., a methoxy PEG-aldehyde), such as PEG-propionaldehyde, which is commercially available from Shearwater Polymers (Huntsville, Ala.). PEG-propionaldehyde is represented by the formula PEG-$CH_2CH_2CHO$. (See, e.g., U.S. Pat. No. 5,252, 714). Other examples of useful activated PEG are PEG acetaldehyde hydrate and PEG bis aldehyde hydrate, which latter yields a bifunctionally activated structure. (See., e.g., Bentley et al., Poly(ethylene glycol) aldehyde hydrates and related polymers and applications in modifying amines, U.S. Pat. No. 5,990,237).

Another useful activated PEG for generating the PEG-conjugated peptides of the present invention is a PEG-maleimide compound, such as, but not limited to, a methoxy PEG-maleimide, such as maleimido monomethoxy PEG, is particularly useful for generating the PEG-conjugated peptides of the invention. (E.g., Shen, N-maleimidyl polymer derivatives, U.S. Pat. No. 6,602,498; C. Delgado et al., The uses and properties of PEG-linked proteins., Crit. Rev. Therap. Drug Carrier Systems, 9:249-304 (1992); S. Zalipsky et al., Use of functionalized poly(ethylene glycol)s for modification of polypeptides, in: Poly(ethylene glycol) chemistry: Biotechnical and biomedical applications (J. M. Harris, Editor, Plenum Press: New York, 347-370 (1992); S. Herman et al., Poly(ethylene glycol) with reactive endgroups: I. Modification of proteins, J. Bioactive Compatible Polymers, 10:145-187 (1995); P. J. Shadle et al., Conjugation of polymer to colony stimulating factor-1, U.S. Pat. No. 4,847,325; G. Shaw et al., Cysteine added variants IL-3 and chemical modifications thereof, U.S. Pat. No. 5,166,322 and EP 0469074 B1; G. Shaw et al., Cysteine added variants of EPO and chemical modifications thereof, EP 0668353 A1; G. Shaw et al., Cysteine added variants G-CSF and chemical modifications thereof, EP 0668354 A1; N. V. Katre et al., Interleukin-2 muteins and polymer conjugation thereof, U.S. Pat. No. 5,206,344; R. J. Goodson and N. V. Katre, Site-directed pegylation of recombinant interleukin-2 at its glycosylation site, Biotechnology, 8:343-346 (1990)).

A poly(ethylene glycol) vinyl sulfone is another useful activated PEG for generating the PEG-conjugated peptides of the present invention by conjugation at thiolated amino acid residues, e.g., at C residues. (E.g., M. Morpurgo et al., Preparation and characterization of poly(ethylene glycol) vinyl sulfone, Bioconj. Chem., 7:363-368 (1996); see also Harris, Functionalization of polyethylene glycol for formation of active sulfone-terminated PEG derivatives for binding to proteins and biologically compatible materials, U.S. Pat. Nos. 5,446,090; 5,739,208; 5,900,461; 6,610,281 and 6,894,025; and Harris, Water soluble active sulfones of poly(ethylene glycol), WO 95/13312 A1).

Another activated form of PEG that is useful in accordance with the present invention, is a PEG-N-hydroxysuccinimide ester compound, for example, methoxy PEG-N-hydroxysuccinimidyl (NHS) ester.

Heterobifunctionally activated forms of PEG are also useful. (See, e.g., Thompson et al., PEGylation reagents and biologically active compounds formed therewith, U.S. Pat. No. 6,552,170).

Typically, a toxin peptide or, a fusion protein comprising the toxin peptide, is reacted by known chemical techniques with an activated PEG compound, such as but not limited to, a thiol-activated PEG compound, a diol-activated PEG compound, a PEG-hydrazide compound, a PEG-oxyamine compound, or a PEG-bromoacetyl compound. (See, e.g., S. Herman, Poly(ethylene glycol) with Reactive Endgroups: I. Modification of Proteins, J. Bioactive and Compatible Polymers, 10:145-187 (1995); S. Zalipsky, Chemistry of Polyethylene Glycol Conjugates with Biologically Active Molecules, Advanced Drug Delivery Reviews, 16:157-182 (1995); R. Greenwald et al., Poly(ethylene glycol) conjugated drugs and prodrugs: a comprehensive review, Critical Reviews in Therapeutic Drug Carrier Systems, 17:101-161 (2000)).

Methods for N-terminal PEGylation are exemplified herein in Examples 31-34, 45 and 47-48, but these are in no way limiting of the PEGylation methods that can be employed by one skilled in the art.

Any molecular mass for a PEG can be used as practically desired, e.g., from about 1,000 or 2,000 Daltons (Da) to about 100,000 Da (n is 20 to 2300). Preferably, the combined or total molecular mass of PEG used in a PEG-conjugated peptide of the present invention is from about 3,000 Da or 5,000 Da, to about 50,000 Da or 60,000 Da (total n is from 70 to 1,400), more preferably from about 10,000 Da to about 40,000 Da (total n is about 230 to about 910). The most preferred combined mass for PEG is from about 20,000 Da to about 30,000 Da (total n is about 450 to about 680). The number of repeating units "n" in the PEG is approximated for the molecular mass described in Daltons. It is preferred that the combined molecular mass of PEG on an activated linker is suitable for pharmaceutical use. Thus, the combined molecular mass of the PEG molecule should not exceed about 100,000 Da.

Polysaccharide polymers are another type of water-soluble polymer that can be used for protein modification. Dextrans are polysaccharide polymers comprised of individual subunits of glucose predominantly linked by α1-6 linkages. The dextran itself is available in many molecular weight ranges, and is readily available in molecular weights from about 1 kD to about 70 kD. Dextran is a suitable water-soluble polymer for use in the present invention as a half-life extending moiety by itself or in combination with another half-life extending moiety (e.g., Fc). See, for example, WO 96/11953 and WO 96/05309. The use of dextran conjugated to therapeutic or diagnostic immunoglobulins has been reported; see, for example, European Patent Publication No. 0 315 456, which is hereby incorporated by reference in its entirety. Dextran of about 1 kD to about 20 kD is preferred when dextran is used as a half-life extending moiety in accordance with the present invention.

Linkers. Any "linker" group or moiety (i.e., "-$(L)_f$-" or "-$(L)_g$-" in Formulae I-IX) is optional. When present, its chemical structure is not critical, since it serves primarily as a spacer. As stated herein above, the linker moiety (-$(L)_f$- and/or -$(L)_g$-), if present, can be independently the same or different from any other linker, or linkers, that may be present in the inventive composition. For example, an "$(L)_f$" can represent the same moiety as, or a different moiety from, any other "$(L)_f$" or any "$(L)_g$" in accordance with the invention. The linker is preferably made up of amino acids linked together by peptide bonds. Thus, in some embodiments, the linker is made up of from 1 to about 30 amino acids linked by peptide bonds, wherein the amino acids are selected from the 20 naturally occurring amino acids. Some of these amino acids can be glycosylated, as is well understood by those in the art. For example, a useful linker sequence constituting a sialylation site is $X_1X_2NX_4X_5G$ (SEQ ID NO: 637), wherein $X_1$, $X_2$, $X_4$ and $X_5$ are each independently any amino acid residue.

In some embodiments, the 1 to 20 amino acids are selected from glycine, alanine, proline, asparagine, glutamine, and lysine. Even more preferably, a linker is made up of a majority of amino acids that are sterically unhindered, such as glycine and alanine. Thus, preferred linkers include polyglycines (particularly (Gly)$_4$, (Gly)$_5$), poly(Gly-Ala), and polyalanines. Other preferred linkers are those identified herein as "L5" (GGGGS; SEQ ID NO: 638), "L10" (GGGGSGGGGS; SEQ ID NO:79), "L25" GGGGSGGGGSGGG GSGGGGSGGGGS; SEQ ID NO:84) and any linkers used in the working examples hereinafter. The linkers described herein, however, are exemplary; linkers within the scope of this invention can be much longer and can include other residues.

In some embodiments of the compositions of this invention, which comprise a peptide linker moiety (L), acidic residues, for example, glutamate or aspartate residues, are placed in the amino acid sequence of the linker moiety (L). Examples include the following peptide linker sequences:

| | |
|---|---|
| GGEGGG; | (SEQ ID NO: 639) |
| GGEEEGGG; | (SEQ ID NO: 640) |
| GEEEG; | (SEQ ID NO: 641) |
| GEEE; | (SEQ ID NO: 642) |
| GGDGGG; | (SEQ ID NO: 643) |
| GGDDDGG; | (SEQ ID NO: 644) |
| GDDDG; | (SEQ ID NO: 645) |
| GDDD; | (SEQ ID NO: 646) |
| GGGGSDDSDEGSDGEDGGGGS; | (SEQ ID NO: 647) |
| WEWEW; | (SEQ ID NO: 648) |
| FEFEF; | (SEQ ID NO: 649) |
| EEEWWW; | (SEQ ID NO: 650) |
| EEEFFF; | (SEQ ID NO: 651) |
| WWEEEWW; or | (SEQ ID NO: 652) |
| FFEEEFF. | (SEQ ID NO: 653) |

In other embodiments, the linker constitutes a phosphorylation site, e.g., $X_1X_2YX_3X_4G$ (SEQ ID NO: 654), wherein $X_1$, $X_2$, $X_3$ and $X_4$ are each independently any amino acid residue; $X_1X_2SX_3X_4G$ (SEQ ID NO: 655), wherein $X_1$, $X_2$, $X_3$ and $X_4$ are each independently any amino acid residue; or $X_1X_2TX_3X_4G$ (SEQ ID NO: 656), wherein $X_1$, $X_2$, $X_3$ and $X_4$ are each independently any amino acid residue.

Non-peptide linkers are also possible. For example, alkyl linkers such as —NH—$(CH_2)_s$—C(O)—, wherein s=2-20 could be used. These alkyl linkers can further be substituted by any non-sterically hindering group such as lower alkyl (e.g., $C_1$-$C_6$) lower acyl, halogen (e.g., Cl, Br), CN, $NH_2$, phenyl, etc. An exemplary non-peptide linker is a PEG linker, (XII)

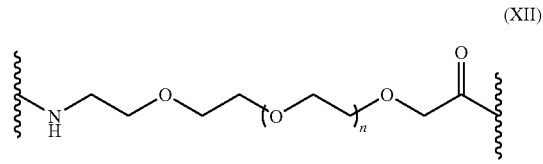

wherein n is such that the linker has a molecular weight of 100 to 5000 kD, preferably 100 to 500 kD. The peptide linkers can be altered to form derivatives in the same manner as described above.

Derivatives. The inventors also contemplate derivatizing the peptide and/or half-life extending moiety portion of the compounds. Such derivatives can improve the solubility, absorption, biological half-life, and the like of the compounds. The moieties can alternatively eliminate or attenuate any undesirable side-effect of the compounds and the like. Exemplary derivatives include compounds in which:

1. The compound or some portion thereof is cyclic. For example, the peptide portion can be modified to contain two or more Cys residues (e.g., in the linker), which could cyclize by disulfide bond formation.

2. The compound is cross-linked or is rendered capable of cross-linking between molecules. For example, the peptide portion can be modified to contain one Cys residue and thereby be able to form an intermolecular disulfide bond with a like molecule. The compound can also be cross-linked through its C-terminus, as in the molecule shown below.

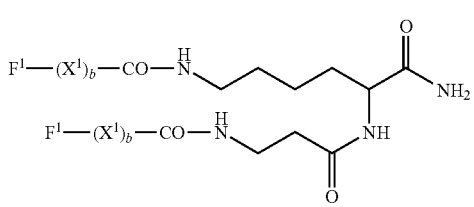

(XIII)

3. Non-peptidyl linkages (bonds) replace one or more peptidyl [—C(O)NR—] linkages. Exemplary non-peptidyl linkages are —$CH_2$-carbamate [—$CH_2$—OC(O)NR—], phosphonate, —$CH_2$-sulfonamide [—$CH_2$—$S(O)_2$NR—], urea [—NHC(O)NH—], —$CH_2$-secondary amine, and alkylated peptide [—C(O)$NR^6$— wherein $R^6$ is lower alkyl].
4. The N-terminus is chemically derivatized. Typically, the N-terminus can be acylated or modified to a substituted amine. Exemplary N-terminal derivative groups include —$NRR^1$ (other than —$NH_2$), —NRC(O)$R^1$, —NRC(O)$OR^1$, —$NRS(O)_2R^1$, —NHC(O)$NHR^1$, succinimide, or benzyloxycarbonyl-NH— (CBZ-NH—), wherein R and $R^1$ are each independently hydrogen or lower alkyl and wherein the phenyl ring can be substituted with 1 to 3 substituents selected from the group consisting of $C_1$-$C_4$ alkyl, $C_1$-$C_4$ alkoxy, chloro, and bromo.
5. The free C-terminus is derivatized. Typically, the C-terminus is esterified or amidated. For example, one can use methods described in the art to add (NH—$CH_2$—$CH_2$—$NH_2)_2$ to compounds of this invention having any of SEQ ID NOS: 504 to 508 at the C-terminus. Likewise, one can use methods described in the art to add —$NH_2$ to compounds of this invention having any of SEQ ID NOS: 924 to 955, 963 to 972, 1005 to 1013, or 1018 to 1023 at the C-terminus. Exemplary C-terminal derivative groups include, for example, —C(O)$R^2$ wherein $R^2$ is lower alkoxy or —$NR^3R^4$ wherein $R^3$ and $R^4$ are independently hydrogen or $C_1$-$C_8$ alkyl (preferably $C_1$-$C_4$ alkyl).
6. A disulfide bond is replaced with another, preferably more stable, cross-linking moiety (e.g., an alkylene). See, e.g., Bhatnagar et al. (1996), *J. Med. Chem.* 39: 3814-9; Alberts et al. (1993) *Thirteenth Am. Pep. Symp.*, 357-9.
7. One or more individual amino acid residues are modified. Various derivatizing agents are known to react specifically with selected sidechains or terminal residues, as described in detail below.

Lysinyl residues and amino terminal residues can be reacted with succinic or other carboxylic acid anhydrides, which reverse the charge of the lysinyl residues. Other suitable reagents for derivatizing alpha-amino-containing residues include imidoesters such as methyl picolinimidate; pyridoxal phosphate; pyridoxal; chloroborohydride; trinitrobenzenesulfonic acid; O-methylisourea; 2,4 pentanedione; and transaminase-catalyzed reaction with glyoxylate.

Arginyl residues can be modified by reaction with any one or combination of several conventional reagents, including phenylglyoxal, 2,3-butanedione, 1,2-cyclohexanedione, and ninhydrin. Derivatization of arginyl residues requires that the reaction be performed in alkaline conditions because of the high pKa of the guanidine functional group. Furthermore, these reagents can react with the groups of lysine as well as the arginine epsilon-amino group.

Specific modification of tyrosyl residues has been studied extensively, with particular interest in introducing spectral labels into tyrosyl residues by reaction with aromatic diazonium compounds or tetranitromethane. Most commonly, N-acetylimidizole and tetranitromethane are used to form O-acetyl tyrosyl species and 3-nitro derivatives, respectively.

Carboxyl sidechain groups (aspartyl or glutamyl) can be selectively modified by reaction with carbodiimides ($R^1$—N=C=N—$R^1$) such as 1-cyclohexyl-3-(2-morpholinyl-(4-ethyl)carbodiimide or 1-ethyl-3-(4-azonia-4,4-dimethylpentyl)carbodiimide. Furthermore, aspartyl and glutamyl residues can be converted to asparaginyl and glutaminyl residues by reaction with ammonium ions.

Glutaminyl and asparaginyl residues can be deamidated to the corresponding glutamyl and aspartyl residues. Alternatively, these residues are deamidated under mildly acidic conditions. Either form of these residues falls within the scope of this invention.

Cysteinyl residues can be replaced by amino acid residues or other moieties either to eliminate disulfide bonding or, conversely, to stabilize cross-linking. See, e.g., Bhatnagar et al. (1996), *J. Med. Chem.* 39: 3814-9.

Derivatization with bifunctional agents is useful for cross-linking the peptides or their functional derivatives to a water-insoluble support matrix or to other macromolecular half-life extending moieties. Commonly used cross-linking agents include, e.g., 1,1-bis(diazoacetyl)-2-phenylethane, glutaraldehyde, N-hydroxysuccinimide esters, for example, esters with 4-azidosalicylic acid, homobifunctional imidoesters, including disuccinimidyl esters such as 3,3'-dithiobis(succinimidylpropionate), and bifunctional maleimides such as bis-N-maleimido-1,8-octane. Derivatizing agents such as methyl-3-[(p-azidophenyl)dithio]propioimidate yield photoactivatable intermediates that are capable of forming crosslinks in the presence of light. Alternatively, reactive water-insoluble matrices such as cyanogen bromide-activated carbohydrates and the reactive substrates described in U.S. Pat. Nos. 3,969,287; 3,691,016; 4,195,128; 4,247,642; 4,229,537; and 4,330,440 are employed for protein immobilization.

Carbohydrate (oligosaccharide) groups can conveniently be attached to sites that are known to be glycosylation sites in proteins. Generally, O-linked oligosaccharides are attached to serine (Ser) or threonine (Thr) residues while N-linked oligosaccharides are attached to asparagine (Asn) residues when they are part of the sequence Asn-X-Ser/Thr, where X can be any amino acid except proline. X is preferably one of the 19 naturally occurring amino acids other than proline. The structures of N-linked and O-linked oligosaccharides and the sugar residues found in each type are different. One type of sugar that is commonly found on both is N-acetylneuraminic acid (referred to as sialic acid). Sialic acid is usually the terminal residue of both N-linked and O-linked oligosaccharides and, by virtue of its negative charge, can confer acidic properties to the glycosylated compound. Such site(s) can be incorporated in the linker of the compounds of this invention and are preferably glycosylated by a cell during recombinant production of the polypeptide compounds (e.g., in mammalian cells such as CHO, BHK, COS). However, such sites can further be glycosylated by synthetic or semi-synthetic procedures known in the art.

Other possible modifications include hydroxylation of proline and lysine, phosphorylation of hydroxyl groups of seryl or threonyl residues, oxidation of the sulfur atom in Cys, methylation of the alpha-amino groups of lysine, arginine, and histidine side chains. Creighton, *Proteins: Structure and Molecule Properties* (W. H. Freeman and Co., San Francisco), pp. 79-86 (1983).

Compounds of the present invention can be changed at the DNA level, as well. The DNA sequence of any portion of the compound can be changed to codons more compatible with the chosen host cell. For *E. coli*, which is the preferred host cell, optimized codons are known in the art. Codons can be substituted to eliminate restriction sites or to include silent restriction sites, which can aid in processing of the DNA in the selected host cell. The half-life extending moiety, linker and peptide DNA sequences can be modified to include any of the foregoing sequence changes.

A process for preparing conjugation derivatives is also contemplated. Tumor cells, for example, exhibit epitopes not found on their normal counterparts. Such epitopes include, for example, different post-translational modifications resulting from their rapid proliferation. Thus, one aspect of this invention is a process comprising:

a) selecting at least one randomized peptide that specifically binds to a target epitope; and
b) preparing a pharmacologic agent comprising (i) at least one half-life extending moiety (Fc domain preferred), (ii) at least one amino acid sequence of the selected peptide or peptides, and (iii) an effector molecule.

The target epitope is preferably a tumor-specific epitope or an epitope specific to a pathogenic organism. The effector molecule can be any of the above-noted conjugation partners and is preferably a radioisotope.

Methods of Making

The present invention also relates to nucleic acids, expression vectors and host cells useful in producing the polypeptides of the present invention. Host cells can be eukaryotic cells, with mammalian cells preferred and CHO cells most preferred. Host cells can also be prokaryotic cells, with *E. coli* cells most preferred.

The compounds of this invention largely can be made in transformed host cells using recombinant DNA techniques. To do so, a recombinant DNA molecule coding for the peptide is prepared. Methods of preparing such DNA molecules are well known in the art. For instance, sequences coding for the peptides could be excised from DNA using suitable restriction enzymes. Alternatively, the DNA molecule could be synthesized using chemical synthesis techniques, such as the phosphoramidate method. Also, a combination of these techniques could be used The invention also includes a vector capable of expressing the peptides in an appropriate host. The vector comprises the DNA molecule that codes for the peptides operatively linked to appropriate expression control sequences. Methods of effecting this operative linking, either before or after the DNA molecule is inserted into the vector, are well known. Expression control sequences include promoters, activators, enhancers, operators, ribosomal binding sites, start signals, stop signals, cap signals, polyadenylation signals, and other signals involved with the control of transcription or translation.

The resulting vector having the DNA molecule thereon is used to transform an appropriate host. This transformation can be performed using methods well known in the art.

Any of a large number of available and well-known host cells can be used in the practice of this invention. The selection of a particular host is dependent upon a number of factors recognized by the art. These include, for example, compatibility with the chosen expression vector, toxicity of the peptides encoded by the DNA molecule, rate of transformation, ease of recovery of the peptides, expression characteristics, bio-safety and costs. A balance of these factors must be struck with the understanding that not all hosts can be equally effective for the expression of a particular DNA sequence. Within these general guidelines, useful microbial hosts include bacteria (such as *E. coli* sp.), yeast (such as *Saccharomyces* sp.) and other fungi, insects, plants, mammalian (including human) cells in culture, or other hosts known in the art.

Next, the transformed host is cultured and purified. Host cells can be cultured under conventional fermentation conditions so that the desired compounds are expressed. Such fermentation conditions are well known in the art. Finally, the peptides are purified from culture by methods well known in the art.

The compounds can also be made by synthetic methods. Solid phase synthesis is the preferred technique of making individual peptides since it is the most cost-effective method of making small peptides. For example, well known solid phase synthesis techniques include the use of protecting groups, linkers, and solid phase supports, as well as specific protection and deprotection reaction conditions, linker cleavage conditions, use of scavengers, and other aspects of solid phase peptide synthesis. Suitable techniques are well known in the art. (E.g., Merrifield (1973), *Chem. Polypeptides*, pp. 335-61 (Katsoyannis and Panayotis eds.); Merrifield (1963), *J. Am. Chem. Soc.* 85: 2149; Davis et al. (1985), *Biochem. Intl.* 10: 394-414; Stewart and Young (1969), *Solid Phase Peptide Synthesis*; U.S. Pat. No. 3,941,763; Finn et al. (1976), *The Proteins* (3rd ed.) 2: 105-253; and Erickson et al. (1976), *The Proteins* (3rd ed.) 2: 257-527; "Protecting Groups in Organic Synthesis," 3rd Edition, T. W. Greene and P. G. M. Wuts, Eds., John Wiley & Sons, Inc., 1999; NovaBiochem Catalog, 2000; "Synthetic Peptides, A User's Guide," G. A. Grant, Ed., W. H. Freeman & Company, New York, N.Y., 1992; "Advanced Chemtech Handbook of Combinatorial & Solid Phase Organic Chemistry," W. D. Bennet, J. W. Christensen, L. K. Hamaker, M. L. Peterson, M. R. Rhodes, and H. H. Saneii, Eds., Advanced Chemtech, 1998; "Principles of Peptide Synthesis, 2nd ed.," M. Bodanszky, Ed., Springer-Verlag, 1993; "The Practice of Peptide Synthesis, 2nd ed.," M. Bodanszky and A. Bodanszky, Eds., Springer-Verlag, 1994; "Protecting Groups," P. J. Kocienski, Ed., Georg Thieme Verlag, Stuttgart, Germany, 1994; "Fmoc Solid Phase Peptide Synthesis, A Practical Approach," W. C. Chan and P. D. White, Eds., Oxford Press, 2000, G. B. Fields et al., Synthetic Peptides: A User's Guide, 1990, 77-183).

Whether the compositions of the present invention are prepared by synthetic or recombinant techniques, suitable protein purification techniques can also be involved, when applicable. In some embodiments of the compositions of the invention, the toxin peptide portion and/or the half-life extending portion, or any other portion, can be prepared to include a suitable isotopic label (e.g., $^{125}$I, $^{14}$C, $^{13}$C, $^{35}$S, $^{3}$H, $^{2}$H, $^{13}$N, $^{15}$N, $^{18}$O, $^{17}$O, etc.), for ease of quantification or detection.

Compounds that contain derivatized peptides or which contain non-peptide groups can be synthesized by well-known organic chemistry techniques.

Uses of the Compounds

In General. The compounds of this invention have pharmacologic activity resulting from their ability to bind to proteins of interest as agonists, mimetics or antagonists of the native ligands of such proteins of interest. Heritable diseases that have a known linkage to ion channels ("channelopathies")

cover various fields of medicine, some of which include neurology, nephrology, myology and cardiology. A list of inherited disorders attributed to ion channels includes:

cystic fibrosis (Cl⁻ channel; CFTR),
Dent's disease (proteinuria and hypercalciuria; Cl⁻ channel; CLCN5),
osteopetrosis (Cl⁻ channel; CLCN7),
familial hyperinsulinemia (SUR1; KCNJ11; K channel),
diabetes (KATP/SUR channel),
Andersen syndrome (KCNJ2, Kir2.1 K channel),
Bartter syndrome (KCNJ1; Kir1.1/ROMK; K channel),
hereditary hearing loss (KCNQ4; K channel),
hereditary hypertension (Liddle's syndrome; SCNN1; epithelial Na channel),
dilated cardiomyopathy (SUR2, K channel),
long-QT syndrome or cardiac arrhythmias (cardiac potassium and sodium channels),
Thymothy syndrome (CACNA1C, Cav1.2),
myasthenic syndromes (CHRNA, CHRNB, CNRNE; nAChR), and a variety of other myopathies,
hyperkalemic periodic paralysis (Na and K channels),
epilepsy (Na⁺ and K⁺ channels),
hemiplegic migraine (CACNA1A, Cav2.1 Ca²⁺ channel and ATP1A2),
central core disease (RYR1, RyR1; Ca²⁺ channel), and
paramyotonia and myotonia (Na⁺, Cl⁻ channels)

See L. J. Ptacek and Y-H Fu (2004), *Arch. Neurol.* 61: 166-8; B. A. Niemeyer et al. (2001), *EMBO reports* 21: 568-73; F. Lehmann-Horn and K. Jurkat-Rott (1999), *Physiol. Rev.* 79: 1317-72. Although the foregoing list concerned disorders of inherited origin, molecules targeting the channels cited in these disorders can also be useful in treating related disorders of other, or indeterminate, origin.

In addition to the aforementioned disorders, evidence has also been provided supporting ion channels as targets for treatment of:

sickle cell anemia (IKCa1)—in sickle cell anemia, water loss from erythrocytes leads to hemoglobin polymerization and subsequent hemolysis and vascular obstruction. The water loss is consequent to potassium efflux through the so-called Gardos channel i.e., IKCa1. Therefore, block of IKCa1 is a potential therapeutic treatment for sickle cell anemia.
glaucoma (BKCa),—in glaucoma the intraocular pressure is too high leading to optic nerve damage, abnormal eye function and possibly blindness. Block of BKCa potassium channels can reduce intraocular fluid secretion and increase smooth muscle contraction, possibly leading to lower intraocular pressure and neuroprotection in the eye.
multiple sclerosis (Kv, KCa),
psoriasis (Kv, KCa),
arthritis (Kv, KCa),
asthma (KCa, Kv),
allergy (KCa, Kv),
COPD (KCa, Kv, Ca),
allergic rhinitis (KCa, Kv),
pulmonary fibrosis,
lupus (IKCa1, Kv),
transplantation, GvHD (KCa, Kv),
inflammatory bone resorption (KCa, Kv),
periodontal disease (KCa, Kv),
diabetes, type I (Kv),—type I diabetes is an autoimmune disease that is characterized by abnormal glucose, protein and lipid metabolism and is associated with insulin deficiency or resistance. In this disease, Kv1.3-expressing T-lymphocytes attack and destroy pancreatic islets leading to loss of beta-cells. Block of Kv1.3 decreases inflammatory cytokines. In addition block of Kv1.3 facilitates the translocation of GLUT4 to the plasma membrane, thereby increasing insulin sensitivity.
obesity (Kv),—Kv1.3 appears to play a critical role in controlling energy homeostasis and in protecting against diet-induced obesity. Consequently, Kv1.3 blockers could increase metabolic rate, leading to greater energy utilization and decreased body weight.
restenosis (KCa, Ca²⁺),—proliferation and migration of vascular smooth muscle cells can lead to neointimal thickening and vascular restenosis. Excessive neointimal vascular smooth muscle cell proliferation is associated with elevated expression of IKCa1. Therefore, block of IKCa1 could represent a therapeutic strategy to prevent restenosis after angioplasty.
ischaemia (KCa, Ca²⁺),—in neuronal or cardiac ischemia, depolarization of cell membranes leads to opening of voltage-gated sodium and calcium channels. In turn this can lead to calcium overload, which is cytotoxic. Block of voltage-gated sodium and/or calcium channels can reduce calcium overload and provide cytoprotective effects. In addition, due to their critical role in controlling and stabilizing cell membrane potential, modulators of voltage- and calcium-activated potassium channels can also act to reduce calcium overload and protect cells.
renal incontinence (KCa), renal incontinence is associated with overactive bladder smooth muscle cells. Calcium-activated potassium channels are expressed in bladder smooth muscle cells, where they control the membrane potential and indirectly control the force and frequency of cell contraction. Openers of calcium-activated potassium channels therefore provide a mechanism to dampen electrical and contractile activity in bladder, leading to reduced urge to urinate.
osteoporosis (Kv),
pain, including migraine (Na$_v$, TRP [transient receptor potential channels], P2X, Ca²⁺), N-type voltage-gated calcium channels are key regulators of nociceptive neurotransmission in the spinal cord. Ziconotide, a peptide blocker of N-type calcium channels reduces nociceptive neurotransmission and is approved worldwide for the symptomatic alleviation of severe chronic pain in humans. Novel blockers of nociceptor-specific N-type calcium channels would be improved analgesics with reduced side-effect profiles.
hypertension (Ca²⁺),—L-type and T-type voltage-gated calcium channels are expressed in vascular smooth muscle cells where they control excitation-contraction coupling and cellular proliferation. In particular, T-type calcium channel activity has been linked to neointima formation during hypertension. Blockers of L-type and T-type calcium channels are useful for the clinical treatment of hypertension because they reduce calcium influx and inhibit smooth muscle cell contraction.
wound healing, cell migration serves a key role in wound healing. Intracellular calcium gradients have been implicated as important regulators of cellular migration machinery in keratinocytes and fibroblasts. In addition, ion flux across cell membranes is associated with cell volume changes. By controlling cell volume, ion channels contribute to the intracellular environment that is required for operation of the cellular migration machinery. In particular, IKCa1 appears to be required universally for cell migration. In addition, Kv1.3, Kv3.1, NMDA receptors and N-type calcium channels are associated with the migration of lymphocytes and neurons. stroke, Alzheimer's, Parkenson's Disease (nACHR, Nav) Bipolar Disorder (Nav, Cav)

cancer, many potassium channel genes are amplified and protein subunits are upregulated in many cancerous condition. Consistent with a pathophysiological role for potassium channel upregulation, potassium channel blockers have been shown to suppress proliferation of uterine cancer cells and hepatocarcinoma cells, presumably through inhibition of calcium influx and effects on calcium-dependent gene expression.

a variety of neurological, cardiovascular, metabolic and autoimmune diseases.

Both agonists and antagonists of ion channels can achieve therapeutic benefit. Therapeutic benefits can result, for example, from antagonizing Kv1.3, IKCa1, SKCa, BKCa, N-type or T-type $Ca^{2+}$ channels and the like. Small molecule and peptide antagonists of these channels have been shown to possess utility in vitro and in vivo. Limitations in production efficiency and pharmacokinetics, however, have largely prevented clinical investigation of inhibitor peptides of ion channels.

Compositions of this invention incorporating peptide antagonists of the voltage-gated potassium channel Kv1.3 are useful as immunosuppressive agents with therapeutic value for autoimmune diseases. For example, such molecules are useful in treating multiple sclerosis, type 1 diabetes, psoriasis, inflammatory bowel disease, and rheumatoid arthritis. (See, e.g., H. Wulff et al. (2003) J. Clin. Invest. 111, 1703-1713 and H. Rus et al. (2005) PNAS 102, 11094-11099; Beeton et al., Targeting effector memory T cells with a selective inhibitor peptide of Kv1.3 channnels for therapy of autoimmune diseases, Molec. Pharmacol. 67(4):1369-81 (2005); 1 Beeton et al. (2006), Kv1.3: therapeutic target for cell-mediated autoimmune disease, electronic preprint at //webfiles.uci.edu/xythoswfs/webui/2670029.1). Inhibitors of the voltage-gated potassium channel Kv1.3 have been examined in a variety of preclinical animal models of inflammation. Small molecule and peptide inhibitors of Kv1.3 have been shown to block delayed type hypersensitivity responses to ovalbumin [C. Beeton et al. (2005) Mol. Pharmacol. 67, 1369] and tetanus toxoid [G. C. Koo et al. (1999) Clin. Immunol. 197, 99]. In addition to suppressing inflammation in the skin, inhibitors also reduced antibody production [G. C. Koo et al. (1997) J. Immunol. 158, 5120]. Kv1.3 antagonists have shown efficacy in a rat adoptive-transfer experimental autoimmune encephalomyelitis (AT-EAE) model of multiple sclerosis (MS). The Kv1.3 channel is overexpressed on myelin-specific T cells from MS patients, lending further support to the utility Kv1.3 inhibitors may provide in treating MS. Inflammatory bone resorption was also suppressed by Kv1.3 inhibitors in a preclinical adoptive-transfer model of periodontal disease [P. Valverde et al. (2004) J. Bone Mineral Res. 19, 155]. In this study, inhibitors additionally blocked antibody production to a bacterial outer membrane protein,— one component of the bacteria used to induce gingival inflammation. Recently in preclinical rat models, efficacy of Kv1.3 inhibitors was shown in treating pristane-induced arthritis and diabetes [C. Beeton et al. (2006) preprint available at //webfiles.uci.edu/xythoswfs/webui/_xy-2670029_1.]. The Kv1.3 channel is expressed on all subsets of T cells and B cells, but effector memory T cells and class-switched memory B cells are particularly dependent on Kv1.3 [H. Wulff et al. (2004) J. Immunol. 173, 776]. Gad5/insulin-specific T cells from patients with new onset type 1 diabetes, myelin-specific T cells from MS patients and T cells from the synovium of rheumatoid arthritis patients all overexpress Kv1.3 [C. Beeton et al. (2006) preprint at //webfiles.uci.edu/xythoswfs/webui/_xy-2670029_1.]. Because mice deficient in Kv1.3 gained less weight when placed on a high fat diet [J. Xu et al. (2003) Human Mol. Genet. 12, 551] and showed altered glucose utilization [J. Xu et al. (2004) Proc. Natl. Acad. Sci. 101, 3112], Kv1.3 is also being investigated for the treatment of obesity and diabetes. Breast cancer specimens [M. Abdul et al. (2003) Anticancer Res. 23, 3347] and prostate cancer cell lines [S. P. Fraser et al. (2003) Pflugers Arch. 446, 559] have also been shown to express Kv1.3, and Kv1.3 blockade may be of utility for treatment of cancer. Disorders that can be treated in accordance with the inventive method of treating an autoimmune disorder, involving Kv1.3 inhibitor toxin peptide(s), include multiple sclerosis, type 1 diabetes, psoriasis, inflammatory bowel disease, contact-mediated dermatitis, rheumatoid arthritis, psoriatic arthritis, asthma, allergy, restinosis, systemic sclerosis, fibrosis, scleroderma, glomerulonephritis, Sjogren syndrome, inflammatory bone resorption, transplant rejection, graft-versus-host disease, and systemic lupus erythematosus (SLE) and other forms of lupus.

Some of the cells that express the calcium-activated potassium of intermediate conductance IKCa1 include T cells, B cells, mast cells and red blood cells (RBCs). T cells and RBCs from mice deficient in IKCa1 show defects in volume regulation [T. Begenisich et al. (2004) J. Biol. Chem. 279, 47681]. Preclinical and clinical studies have demonstrated IKCa1 inhibitors utility in treating sickle cell anemia [J. W. Stocker et al. (2003) Blood 101, 2412; www.icagen.com]. Blockers of the IKCa1 channel have also been shown to block EAE, indicating they may possess utility in treatment of MS [E. P. Reich et al. (2005) Eur. J. Immunol. 35, 1027]. IgE-mediated histamine production from mast cells is also blocked by IKCa1 inhibitors [S. Mark Duffy et al. (2004) J. Allergy Clin. Immunol. 114, 66], therefore they may also be of benefit in treating asthma. The IKCa1 channel is overexpressed on activated T and B lymphocytes [H. Wulff et al. (2004) J. Immunol. 173, 776] and thus may show utility in treatment of a wide variety of immune disorders. Outside of the immune system, IKCa1 inhibitors have also shown efficacy in a rat model of vascular restinosis and thus might represent a new therapeutic strategy to prevent restenosis after angioplasty [R. Kohler et al. (2003) Circulation 108, 1119]. It is also thought that IKCa1 antagonists are of utility in treatment of tumor angiogenesis since inhibitors suppressed endothelial cell proliferation and angionenesis in vivo [I. Grgic et al. (2005) Arterioscler. Thromb. Vasc. Biol. 25, 704]. The IKCa1 channel is upregulated in pancreatic tumors and inhibitors blocked proliferation of pancreatic tumor cell lines [H. Jager et al. (2004) Mol Pharmacol. 65, 630]. IKCa1 antagonists may also represent an approach to attenuate acute brain damage caused by traumatic brain injury [F. Mauler (2004) Eur. J. Neurosci. 20, 1761]. Disorders that can be treated with IKCa1 inhibitors include multiple sclerosis, asthma, psoriasis, contact-mediated dermatitis, rheumatoid & psoriatic arthritis, inflammatory bowel disease, transplant rejection, graft-versus-host disease, Lupus, restinosis, pancreatic cancer, tumor angiogenesis and traumatic brain injury.

Accordingly, molecules of this invention incorporating peptide antagonists of the calcium-activated potassium channel of intermediate conductance, IKCa can be used to treat immune dysfunction, multiple sclerosis, type 1 diabetes, psoriasis, inflammatory bowel disease, contact-mediated dermatitis, rheumatoid arthritis, psoriatic arthritis, asthma, allergy, restinosis, systemic sclerosis, fibrosis, scleroderma, glomerulonephritis, Sjogren syndrome, inflammatory bone resorption, transplant rejection, graft-versus-host disease, and lupus.

Accordingly, the present invention includes a method of treating an autoimmune disorder, which involves administering to a patient who has been diagnosed with an autoimmune disorder, such as multiple sclerosis, type 1 diabetes, psoriasis, inflammatory bowel disease, contact-mediated dermatitis, rheumatoid arthritis, psoriatic arthritis, asthma, allergy, restinosis, systemic sclerosis, fibrosis, scleroderma, glomerulonephritis, Sjogren syndrome, inflammatory bone resorption, transplant rejection, graft-versus-host disease, or lupus, a therapeutically effective amount of the inventive composition of matter, whereby at least one symptom of the disorder is alleviated in the patient. "Alleviated" means to be lessened, lightened, diminished, softened, mitigated (i.e., made more mild or gentle), quieted, assuaged, abated, relieved, nullified, or allayed, regardless of whether the symptom of interest is entirely erased, eradicated, eliminated, or prevented in a particular patient.

The present invention is further directed to a method of preventing or mitigating a relapse of a symptom of multiple sclerosis, which method involves administering to a patient, who has previously experienced at least one symptom of multiple sclerosis, a prophylactically effective amount of the inventive composition of matter, such that the at least one symptom of multiple sclerosis is prevented from recurring or is mitigated.

The inventive compositions of matter preferred for use in practicing the inventive method of treating an autoimmune disorder and the method of preventing or mitigating a relapse of a symptom of multiple sclerosis include as P (conjugated as in Formula I), a Kv1.3 or IKCa1 antagonist peptide, such as a ShK peptide, an OSK1 peptide, a ChTx peptide and/or a Maurotoxin (MTx) peptide, or peptide analogs of any of these.

For example, the conjugated ShK peptide peptide or ShK peptide analog can comprise an amino acid sequence selected from the following:
SEQ ID NOS: 5, 88 through 200, 548 through 561, 884 through 950, or 1295 through 1300 as set forth in Table 2.

The conjugated OSK1 peptide peptide or OSK1 peptide analog can comprise an amino acid sequence selected from the following:
SEQ ID NOS: 25, 294 through 298, 562 through 636, 980 through 1274,
GVIINVSCKISRQCLEPCKKAGMRFGKC-
  MNGKCHCTPK (OSK1-S7) (SEQ ID NO: 1303), or
GVIINVSCKISRQCLKPCKDAGMRFGKC-
  MNGKCHCTPK (OSK1-S7,K16,D20) (SEQ ID NO: 1308) as set forth in Table 7.

Also by way of example, a the conjugated MTX peptide, MTX peptide analog, ChTx peptide or ChTx peptide analog can comprise an amino acid sequence selected from:
SEQ ID NOS: 20, 330 through 343, 1301, 1302, 1304 through 1307, 1309, 1311, 1312, or 1315 through 1336 as set forth in Table 13; or SEQ ID NOS: 36, 59, 344 through 346, or 1369 through 1390 as set forth in Table 14.

Also useful in these methods conjugated, or unconjugated, are a Kv1.3 or IKCa1 inhibitor toxin peptide analog that comprises an amino acid sequence selected from:
SEQ ID NOS: 88, 89, 92, 148 through 200, 548 through 561, 884 through 949, or 1295 through 1300 as set forth in Table 2; or
SEQ ID NOS: 980 through 1274, GVIINVSCKISRQ-
  CLEPCKKAGMRFGKCMNGKCHCTPK (OSK1-S7) (SEQ ID NO: 1303), or GVIINVSCKISRQCLKPCK-
  DAGMRFGKCMNGKCHCTPK (OSK1-S7,K16,D20) (SEQ ID NO: 1308) as set forth in Table 7; or
SEQ ID NOS: 330 through 337, 341, 1301, 1302, 1304 through 1307, 1309, 1311, 1312, and 1315 through 1336 as set forth in Table 13.

In accordance with these inventive methods, a patient who has been diagnosed with an autoimmune disorder, such as, but not limited to multiple sclerosis, type 1 diabetes, psoriasis, inflammatory bowel disease, contact-mediated dermatitis, rheumatoid arthritis, psoriatic arthritis, asthma, allergy, restinosis, systemic sclerosis, fibrosis, scleroderma, glomerulonephritis, Sjogren syndrome, inflammatory bone resorption, transplant rejection, graft-versus-host disease, or lupus, or a patient who has previously experienced at least one symptom of multiple sclerosis, are well-recognizable and/or diagnosed by the skilled practitioner, such as a physician, familiar with autoimmune disorders and their symptoms.

For example, symptoms of multiple sclerosis can include the following:

visual symptoms, such as, optic neuritis (blurred vision, eye pain, loss of color vision, blindness); diplopia (double vision); nystagmus (jerky eye movements); ocular dysmetria (constant under- or overshooting eye movements); internuclear ophthalmoplegia (lack of coordination between the two eyes, nystagmus, diplopia); movement and sound phosphenes (flashing lights when moving eyes or in response to a sudden noise); afferent pupillary defect (abnormal pupil responses);

motor symptoms, such as, paresis, monoparesis, paraparesis, hemiparesis, quadraparesis (muscle weakness—partial or mild paralysis); plegia, paraplegia, hemiplegia, tetraplegia, quadraplegia (paralysis—total or near total loss of muscle strength); spasticity (loss of muscle tone causing stiffness, pain and restricting free movement of affected limbs); dysarthria (slurred speech and related speech problems); muscle atrophy (wasting of muscles due to lack of use); spasms, cramps (involuntary contraction of muscles); hypotonia, clonus (problems with posture); myoclonus, myokymia (jerking and twitching muscles, tics); restless leg syndrome (involuntary leg movements, especially bothersome at night); footdrop (foot drags along floor during walking); dysfunctional reflexes (MSRs, Babinski's, Hoffman's, Chaddock's);

sensory symptoms, such as, paraesthesia (partial numbness, tingling, buzzing and vibration sensations); anaesthesia (complete numbness/loss of sensation); neuralgia, neuropathic and neurogenic pain (pain without apparent cause, burning, itching and electrical shock sensations); L'Hermitte's (electric shocks and buzzing sensations when moving head); proprioceptive dysfunction (loss of awareness of location of body parts); trigeminal neuralgia (facial pain);

coordination and balance symptoms, such as, ataxia (loss of coordination); intention tremor (shaking when performing fine movements); dysmetria (constant under- or overshooting limb movements); vestibular ataxia (abnormal balance function in the inner ear); vertigo (nausea/vomitting/sensitivity to travel sickness from vestibular ataxia); speech ataxia (problems coordinating speech, stuttering); dystonia (slow limb position feedback); dysdiadochokinesia (loss of ability to produce rapidly alternating movements, for example to move to a rhythm);

bowel, bladder and sexual symptoms, such as, frequent micturation, bladder spasticity (urinary urgency and incontinence); flaccid bladder, detrusor-sphincter dyssynergia (urinary hesitancy and retention); erectile dysfunction (male and female impotence); anorgasmy (inability to achieve orgasm); retrograde ejaculation (ejaculating into the bladder); frigidity (inability to become sexually aroused); constipation (infrequent or irregular bowel movements); fecal urgency (bowel urgency); fecal incontinence (bowel incontinence);

cognitive symptoms, such as, depression; cognitive dysfunction (short-term and long-term memory problems, forgetfulness, slow word recall); dementia; mood swings, emotional lability, euphoria; bipolar syndrome; anxiety; aphasia, dysphasia (impairments to speech comprehension and production); and other symptoms, such as, fatigue; Uhthoff's Symptom (increase in severity of symptoms with heat); gastroesophageal reflux (acid reflux); impaired sense of taste and smell; epileptic seizures; swallowing problems, respiratory problems; and sleeping disorders.

The symptoms of multiple sclerosis enumerated above, are merely illustrative and are not intended to be an exhaustive description of all possible symptoms experienced by a single patient or by several sufferers in composite, and to which the present invention is directed. Those skilled in the art are aware of various clinical symptoms and constellations of symptoms of autoimmune disorders suffered by individual patients, and to those symptoms are also directed the present inventive methods of treating an autoimmune disorder or of preventing or mitigating a relapse of a symptom of multiple sclerosis.

The therapeutically effective amount, prophylactically effective amount, and dosage regimen involved in the inventive methods of treating an autoimmune disorder or of preventing or mitigating a relapse of a symptom of multiple sclerosis, will be determined by the attending physician, considering various factors which modify the action of therapeutic agents, such as the age, condition, body weight, sex and diet of the patient, the severity of the condition being treated, time of administration, and other clinical factors. Generally, the daily amount or regimen should be in the range of about 1 to about 10,000 micrograms (µg) of the vehicle-conjugated peptide per kilogram (kg) of body mass, preferably about 1 to about 5000 µg per kilogram of body mass, and most preferably about 1 to about 1000 µg per kilogram of body mass.

Molecules of this invention incorporating peptide antagonists of the voltage-gated potassium channel Kv2.1 can be used to treat type II diabetes.

Molecules of this invention incorporating peptide antagonists of the M current (e.g., BeKm-1) can be used to treat Alzheimer's disease and enhance cognition.

Molecules of this invention incorporating peptide antagonists of the voltage-gated potassium channel Kv4.3 can be used to treat Alzheimer's disease.

Molecules of this invention incorporating peptide antagonists of the calcium-activated potassium channel of small conductance, SKCa can be used to treat epilepsy, memory, learning, neuropsychiatric, neurological, neuromuscular, and immunological disorders, schizophrenia, bipolar disorder, sleep apnea, neurodegeneration, and smooth muscle disorders.

Molecules of this invention incorporating N-type calcium channel antagonist peptides are useful in alleviating pain. Peptides with such activity (e.g., Ziconotide™, ω-conotoxin-MVIIA) have been clinically validated.

Molecules of this invention incorporating T-type calcium channel antagonist peptides are useful in alleviating pain. Several lines of evidence have converged to indicate that inhibition of Cav3.2 in dorsal root ganglia may bring relief from chronic pain. T-type calcium channels are found at extremely high levels in the cell bodies of a subset of neurons in the DRG; these are likely mechanoreceptors adapted to detect slowly-moving stimuli (Shin et al., Nature Neuroscience 6:724-730, 2003), and T-type channel activity is likely responsible for burst spiking (Nelson et al., J Neurosci 25:8766-8775, 2005). Inhibition of T-type channels by either mibefradil or ethosuximide reverses mechanical allodynia in animals induced by nerve injury (Dogrul et al., Pain 105:159-168, 2003) or by chemotherapy (Flatters and Bennett, Pain 109:150-161, 2004). Antisense to Cav3.2, but not Cav3.1 or Cav3.3, increases pain thresholds in animals and also reduces expression of Cav3.2 protein in the DRG (Bourinet et al., EMBO J 24:315-324, 2005). Similarly, locally injected reducing agents produce pain and increase Cav3.2 currents, oxidizing agents reduce pain and inhibit Cav3.2 currents, and peripherally administered neurosteroids are analgesic and inhibit T-type currents from DRG (Todorovic et al., Pain 109:328-339, 2004; Pathirathna et al., Pain 114:429-443, 2005). Accordingly, it is thought that inhibition of Cav3.2 in the cell bodies of DRG neurons can inhibit the repetitive spiking of these neurons associated with chronic pain states.

Molecules of this invention incorporating L-type calcium channel antagonist peptides are useful in treating hypertension. Small molecules with such activity (e.g., DHP) have been clinically validated.

Molecules of this invention incorporating peptide antagonists of the $Na_v1$ ($TTX_S$-type) channel can be used to alleviate pain. Local anesthetics and tricyclic antidepressants with such activity have been clinically validated. Such molecules of this invention can in particular be useful as muscle relaxants.

Molecules of this invention incorporating peptide antagonists of the $Na_v1$ ($TTX_R$-type) channel can be used to alleviate pain arising from nerve and or tissue injury.

Molecules of this invention incorporating peptide antagonists of glial & epithelial cell $Ca^{2+}$-activated chloride channel can be used to treat cancer and diabetes.

Molecules of this invention incorporating peptide antagonists of NMDA receptors can be used to treat pain, epilepsy, brain and spinal cord injury.

Molecules of this invention incorporating peptide antagonists of nicotinic receptors can be used as muscle relaxants. Such molecules can be used to treat pain, gastric motility disorders, urinary incontinence, nicotine addiction, and mood disorders.

Molecules of this invention incorporating peptide antagonists of 5HT3 receptor can be used to treat Nausea, pain, and anxiety.

Molecules of this invention incorporating peptide antagonists of the norepinephrine transporter can be used to treat pain, anti-depressant, learning, memory, and urinary incontinence.

Molecules of this invention incorporating peptide antagonists of the Neurotensin receptor can be used to treat pain.

In addition to therapeutic uses, the compounds of the present invention can be useful in diagnosing diseases characterized by dysfunction of their associated protein of interest. In one embodiment, a method of detecting in a biological sample a protein of interest (e.g., a receptor) that is capable of being activated comprising the steps of: (a) contacting the sample with a compound of this invention; and (b) detecting activation of the protein of interest by the compound. The biological samples include tissue specimens, intact cells, or extracts thereof. The compounds of this invention can be used as part of a diagnostic kit to detect the presence of their associated proteins of interest in a biological sample. Such kits employ the compounds of the invention having an attached label to allow for detection. The compounds are useful for identifying normal or abnormal proteins of interest.

The therapeutic methods, compositions and compounds of the present invention can also be employed, alone or in combination with other molecules in the treatment of disease.

Pharmaceutical Compositions

In General. The present invention also provides pharmaceutical compositions comprising the inventive composition of matter and a pharmaceutically acceptable carrier. Such pharmaceutical compositions can be configured for administration to a patient by a wide variety of delivery routes, e.g., an intravascular delivery route such as by injection or infusion, subcutaneous, intramuscular, intraperitoneal, epidural, or intrathecal delivery routes, or for oral, enteral, pulmonary (e.g., inhalant), intranasal, transmucosal (e.g., sublingual administration), transdermal or other delivery routes and/or forms of administration known in the art. The inventive pharmaceutical compositions may be prepared in liquid form, or may be in dried powder form, such as lyophilized form. For oral or enteral use, the pharmaceutical compositions can be configured, for example, as tablets, troches, lozenges, aqueous or oily suspensions, dispersible powders or granules, emulsions, hard or soft capsules, syrups, elixirs or enteral formulas.

In the practice of this invention the "pharmaceutically acceptable carrier" is any physiologically tolerated substance known to those of ordinary skill in the art useful in formulating pharmaceutical compositions, including, any pharmaceutically acceptable diluents, excipients, dispersants, binders, fillers, glidants, anti-frictional agents, compression aids, tablet-disintegrating agents (disintegrants), suspending agents, lubricants, flavorants, odorants, sweeteners, permeation or penetration enhancers, preservatives, surfactants, solubilizers, emulsifiers, thickeners, adjuvants, dyes, coatings, encapsulating material(s), and/or other additives singly or in combination. Such pharmaceutical compositions can include diluents of various buffer content (e.g., Tris-HCl, acetate, phosphate), pH and ionic strength; additives such as detergents and solubilizing agents (e.g., Tween® 80, Polysorbate 80), anti-oxidants (e.g., ascorbic acid, sodium metabisulfite), preservatives (e.g., Thimersol®, benzyl alcohol) and bulking substances (e.g., lactose, mannitol); incorporation of the material into particulate preparations of polymeric compounds such as polylactic acid, polyglycolic acid, etc. or into liposomes. Hyaluronic acid can also be used, and this can have the effect of promoting sustained duration in the circulation. Such compositions can influence the physical state, stability, rate of in vivo release, and rate of in vivo clearance of the present proteins and derivatives. See, e.g., *Remington's Pharmaceutical Sciences*, 18th Ed. (1990, Mack Publishing Co., Easton, Pa. 18042) pages 1435-1712, which are herein incorporated by reference in their entirety. The compositions can be prepared in liquid form, or can be in dried powder, such as lyophilized form. Implantable sustained release formulations are also useful, as are transdermal or transmucosal formulations. Additionally (or alternatively), the present invention provides compositions for use in any of the various slow or sustained release formulations or microparticle formulations known to the skilled artisan, for example, sustained release microparticle formulations, which can be administered via pulmonary, intranasal, or subcutaneous delivery routes.

One can dilute the inventive compositions or increase the volume of the pharmaceutical compositions of the invention with an inert material. Such diluents can include carbohydrates, especially, mannitol, α-lactose, anhydrous lactose, cellulose, sucrose, modified dextrans and starch. Certain inorganic salts may also be used as fillers, including calcium triphosphate, magnesium carbonate and sodium chloride. Some commercially available diluents are Fast-Flo, Emdex, STA-Rx 1500, Emcompress and Avicell.

A variety of conventional thickeners are useful in creams, ointments, suppository and gel configurations of the pharmaceutical composition, such as, but not limited to, alginate, xanthan gum, or petrolatum, may also be employed in such configurations of the pharmaceutical composition of the present invention. A permeation or penetration enhancer, such as polyethylene glycol monolaurate, dimethyl sulfoxide, N-vinyl-2-pyrrolidone, N-(2-hydroxyethyl)-pyrrolidone, or 3-hydroxy-N-methyl-2-pyrrolidone can also be employed. Useful techniques for producing hydrogel matrices are known. (E.g., Feijen, Biodegradable hydrogel matrices for the controlled release of pharmacologically active agents, U.S. Pat. No. 4,925,677; Shah et al., Biodegradable pH/thermosensitive hydrogels for sustained delivery of biologically active agents, WO 00/38651 A1). Such biodegradable gel matrices can be formed, for example, by crosslinking a proteinaceous component and a polysaccharide or mucopolysaccharide component, then loading with the inventive composition of matter to be delivered.

Liquid pharmaceutical compositions of the present invention that are sterile solutions or suspensions can be administered to a patient by injection, for example, intramuscularly, intrathecally, epidurally, intravascularly (e.g., intravenously or intrarterially), intraperitoneally or subcutaneously. (See, e.g., Goldenberg et al., Suspensions for the sustained release of proteins, U.S. Pat. No. 6,245,740 and WO 00/38652 A1). Sterile solutions can also be administered by intravenous infusion. The inventive composition can be included in a sterile solid pharmaceutical composition, such as a lyophilized powder, which can be dissolved or suspended at a convenient time before administration to a patient using sterile water, saline, buffered saline or other appropriate sterile injectable medium.

Implantable sustained release formulations are also useful embodiments of the inventive pharmaceutical compositions. For example, the pharmaceutically acceptable carrier, being a biodegradable matrix implanted within the body or under the skin of a human or non-human vertebrate, can be a hydrogel similar to those described above. Alternatively, it may be formed from a poly-alpha-amino acid component. (Sidman, Biodegradable, implantable drug delivery device, and process for preparing and using same, U.S. Pat. No. 4,351,337). Other techniques for making implants for delivery of drugs are also known and useful in accordance with the present invention.

In powder forms, the pharmaceutically acceptable carrier is a finely divided solid, which is in admixture with finely divided active ingredient(s), including the inventive composition. For example, in some embodiments, a powder form is useful when the pharmaceutical composition is configured as an inhalant. (See, e.g., Zeng et al., Method of preparing dry powder inhalation compositions, WO 2004/017918; Trunk et al., Salts of the CGRP antagonist BIBN4096 and inhalable powdered medicaments containing them, U.S. Pat. No. 6,900,317).

One can dilute or increase the volume of the compound of the invention with an inert material. These diluents could include carbohydrates, especially mannitol, α-lactose, anhydrous lactose, cellulose, sucrose, modified dextrans and starch. Certain inorganic salts can also be used as fillers including calcium triphosphate, magnesium carbonate and sodium chloride. Some commercially available diluents are Fast-Flo™, Emdex™, STA-Rx™ 1500, Emcompress™ and Avicell™.

Disintegrants can be included in the formulation of the pharmaceutical composition into a solid dosage form. Materials used as disintegrants include but are not limited to starch including the commercial disintegrant based on starch, Explotab™. Sodium starch glycolate, Amberlite™, sodium carboxymethylcellulose, ultramylopectin, sodium alginate, gelatin, orange peel, acid carboxymethyl cellulose, natural sponge and bentonite can all be used. Insoluble cationic exchange resin is another form of disintegrant. Powdered gums can be used as disintegrants and as binders and these can include powdered gums such as agar, Karaya or tragacanth. Alginic acid and its sodium salt are also useful as disintegrants.

Binders can be used to hold the therapeutic agent together to form a hard tablet and include materials from natural products such as acacia, tragacanth, starch and gelatin. Others include methyl cellulose (MC), ethyl cellulose (EC) and carboxymethyl cellulose (CMC). Polyvinyl pyrrolidone (PVP) and hydroxypropylmethyl cellulose (HPMC) could both be used in alcoholic solutions to granulate the therapeutic.

An antifrictional agent can be included in the formulation of the therapeutic to prevent sticking during the formulation process. Lubricants can be used as a layer between the therapeutic and the die wall, and these can include but are not limited to; stearic acid including its magnesium and calcium salts, polytetrafluoroethylene (PTFE), liquid paraffin, vegetable oils and waxes. Soluble lubricants can also be used such as sodium lauryl sulfate, magnesium lauryl sulfate, polyethylene glycol of various molecular weights, Carbowax 4000 and 6000.

Glidants that might improve the flow properties of the drug during formulation and to aid rearrangement during compression might be added. The glidants can include starch, talc, pyrogenic silica and hydrated silicoaluminate.

To aid dissolution of the compound of this invention into the aqueous environment a surfactant might be added as a wetting agent. Surfactants can include anionic detergents such as sodium lauryl sulfate, dioctyl sodium sulfosuccinate and dioctyl sodium sulfonate. Cationic detergents might be used and could include benzalkonium chloride or benzethonium chloride. The list of potential nonionic detergents that could be included in the formulation as surfactants are lauromacrogol 400, polyoxyl 40 stearate, polyoxyethylene hydrogenated castor oil 10, 50 and 60, glycerol monostearate, polysorbate 40, 60, 65 and 80, sucrose fatty acid ester, methyl cellulose and carboxymethyl cellulose. These surfactants could be present in the formulation of the protein or derivative either alone or as a mixture in different ratios.

Oral dosage forms. Also useful are oral dosage forms of the inventive compositionss. If necessary, the composition can be chemically modified so that oral delivery is efficacious. Generally, the chemical modification contemplated is the attachment of at least one moiety to the molecule itself, where said moiety permits (a) inhibition of proteolysis; and (b) uptake into the blood stream from the stomach or intestine. Also desired is the increase in overall stability of the compound and increase in circulation time in the body. Moieties useful as covalently attached half-life extending moieties in this invention can also be used for this purpose. Examples of such moieties include: PEG, copolymers of ethylene glycol and propylene glycol, carboxymethyl cellulose, dextran, polyvinyl alcohol, polyvinyl pyrrolidone and polyproline. See, for example, Abuchowski and Davis (1981), *Soluble Polymer-Enzyme Adducts, Enzymes as Drugs* (Hocenberg and Roberts, eds.), Wiley-Interscience, New York, N.Y., pp 367-83; Newmark, et al. (1982), *J. Appl. Biochem.* 4:185-9. Other polymers that could be used are poly-1,3-dioxolane and poly-1,3,6-tioxocane. Preferred for pharmaceutical usage, as indicated above, are PEG moieties.

For oral delivery dosage forms, it is also possible to use a salt of a modified aliphatic amino acid, such as sodium N-(8-[2-hydroxybenzoyl]amino)caprylate (SNAC), as a carrier to enhance absorption of the therapeutic compounds of this invention. The clinical efficacy of a heparin formulation using SNAC has been demonstrated in a Phase II trial conducted by Emisphere Technologies. See U.S. Pat. No. 5,792,451, "Oral drug delivery composition and methods."

In one embodiment, the pharmaceutically acceptable carrier can be a liquid and the pharmaceutical composition is prepared in the form of a solution, suspension, emulsion, syrup, elixir or pressurized composition. The active ingredient(s) (e.g., the inventive composition of matter) can be dissolved, diluted or suspended in a pharmaceutically acceptable liquid carrier such as water, an organic solvent, a mixture of both, or pharmaceutically acceptable oils or fats. The liquid carrier can contain other suitable pharmaceutical additives such as detergents and/or solubilizers (e.g., Tween 80, Polysorbate 80), emulsifiers, buffers at appropriate pH (e.g., Tris-HCl, acetate, phosphate), adjuvants, anti-oxidants (e.g., ascorbic acid, sodium metabisulfite), preservatives (e.g., Thimersol, benzyl alcohol), sweeteners, flavoring agents, suspending agents, thickening agents, bulking substances (e.g., lactose, mannitol), colors, viscosity regulators, stabilizers, electrolytes, osmolutes or osmo-regulators. Additives can also be included in the formulation to enhance uptake of the inventive composition. Additives potentially having this property are for instance the fatty acids oleic acid, linoleic acid and linolenic acid.

Useful are oral solid dosage forms, which are described generally in *Remington's Pharmaceutical Sciences* (1990), supra, in Chapter 89, which is hereby incorporated by reference in its entirety. Solid dosage forms include tablets, capsules, pills, troches or lozenges, cachets or pellets. Also, liposomal or proteinoid encapsulation can be used to formulate the present compositions (as, for example, proteinoid microspheres reported in U.S. Pat. No. 4,925,673). Liposomal encapsulation can be used and the liposomes can be derivatized with various polymers (e.g., U.S. Pat. No. 5,013, 556). A description of possible solid dosage forms for the therapeutic is given in Marshall, K., *Modern Pharmaceutics* (1979), edited by G. S. Banker and C. T. Rhodes, in Chapter 10, which is hereby incorporated by reference in its entirety. In general, the formulation will include the inventive compound, and inert ingredients that allow for protection against the stomach environment, and release of the biologically active material in the intestine.

The composition of this invention can be included in the formulation as fine multiparticulates in the form of granules or pellets of particle size about 1 mm. The formulation of the material for capsule administration could also be as a powder, lightly compressed plugs or even as tablets. The therapeutic could be prepared by compression.

Colorants and flavoring agents can all be included. For example, the protein (or derivative) can be formulated (such as by liposome or microsphere encapsulation) and then further contained within an edible product, such as a refrigerated beverage containing colorants and flavoring agents.

In tablet form, the active ingredient(s) are mixed with a pharmaceutically acceptable carrier having the necessary compression properties in suitable proportions and compacted in the shape and size desired.

The powders and tablets preferably contain up to 99% of the active ingredient(s). Suitable solid carriers include, for example, calcium phosphate, magnesium stearate, talc, sugars, lactose, dextrin, starch, gelatin, cellulose, polyvinylpyrrolidine, low melting waxes and ion exchange resins.

Controlled release formulation can be desirable. The composition of this invention could be incorporated into an inert matrix that permits release by either diffusion or leaching mechanisms e.g., gums. Slowly degenerating matrices can also be incorporated into the formulation, e.g., alginates, polysaccharides. Another form of a controlled release of the compositions of this invention is by a method based on the Oros™ therapeutic system (Alza Corp.), i.e., the drug is enclosed in a semipermeable membrane which allows water to enter and push drug out through a single small opening due to osmotic effects. Some enteric coatings also have a delayed release effect.

Other coatings can be used for the formulation. These include a variety of sugars that could be applied in a coating pan. The therapeutic agent could also be given in a film-coated tablet and the materials used in this instance are divided into 2 groups. The first are the nonenteric materials and include methylcellulose, ethyl cellulose, hydroxyethyl cellulose, methylhydroxy-ethyl cellulose, hydroxypropyl cellulose, hydroxypropyl-methyl cellulose, sodium carboxymethyl cellulose, providone and the polyethylene glycols. The second group consists of the enteric materials that are commonly esters of phthalic acid.

A mix of materials might be used to provide the optimum film coating. Film coating can be carried out in a pan coater or in a fluidized bed or by compression coating.

Pulmonary delivery forms. Pulmonary delivery of the inventive compositions is also useful. The protein (or derivative) is delivered to the lungs of a mammal while inhaling and traverses across the lung epithelial lining to the blood stream. (Other reports of this include Adjei et al., *Pharma. Res.* (1990) 7: 565-9; Adjei et al. (1990), *Internatl. J. Pharmaceutics* 63: 135-44 (leuprolide acetate); Braquet et al. (1989), *J. Cardiovasc. Pharmacol.* 13 (suppl. 5): s. 143-146 (endothelin-1); Hubbard et al. (1989), *Annals Int. Med.* 3: 206-12 ($\alpha$1-antitrypsin); Smith et al. (1989), *J. Clin. Invest.* 84: 1145-6 ($\alpha$1-proteinase); Oswein et al. (March 1990), "Aerosolization of Proteins," *Proc. Symp. Resp. Drug Delivery II*, Keystone, Colo. (recombinant human growth hormone); Debs et al. (1988), *J. Immunol.* 140: 3482-8 (interferon-$\gamma$ and tumor necrosis factor $\alpha$) and Platz et al., U.S. Pat. No. 5,284, 656 (granulocyte colony stimulating factor). Useful in the practice of this invention are a wide range of mechanical devices designed for pulmonary delivery of therapeutic products, including but not limited to nebulizers, metered dose inhalers, and powder inhalers, all of which are familiar to those skilled in the art. Some specific examples of commercially available devices suitable for the practice of this invention are the Ultravent nebulizer, manufactured by Mallinckrodt, Inc., St. Louis, Mo.; the Acorn II nebulizer, manufactured by Marquest Medical Products, Englewood, Colo.; the Ventolin metered dose inhaler, manufactured by Glaxo Inc., Research Triangle Park, North Carolina; and the Spinhaler powder inhaler, manufactured by Fisons Corp., Bedford, Mass. (See, e.g., Helgesson et al., Inhalation device, U.S. Pat. No. 6,892,728; McDerment et al., Dry powder inhaler, WO 02/11801 A1; Ohki et al., Inhalant medicator, U.S. Pat. No. 6,273,086).

All such devices require the use of formulations suitable for the dispensing of the inventive compound. Typically, each formulation is specific to the type of device employed and can involve the use of an appropriate propellant material, in addition to diluents, adjuvants and/or carriers useful in therapy.

The inventive compound should most advantageously be prepared in particulate form with an average particle size of less than 10 µm (or microns), most preferably 0.5 to 5 µm, for most effective delivery to the distal lung.

Pharmaceutically acceptable carriers include carbohydrates such as trehalose, mannitol, xylitol, sucrose, lactose, and sorbitol. Other ingredients for use in formulations can include DPPC, DOPE, DSPC and DOPC. Natural or synthetic surfactants can be used. PEG can be used (even apart from its use in derivatizing the protein or analog). Dextrans, such as cyclodextran, can be used. Bile salts and other related enhancers can be used. Cellulose and cellulose derivatives can be used. Amino acids can be used, such as use in a buffer formulation.

Also, the use of liposomes, microcapsules or microspheres, inclusion complexes, or other types of carriers is contemplated.

Formulations suitable for use with a nebulizer, either jet or ultrasonic, will typically comprise the inventive compound dissolved in water at a concentration of about 0.1 to 25 mg of biologically active protein per mL of solution. The formulation can also include a buffer and a simple sugar (e.g., for protein stabilization and regulation of osmotic pressure). The nebulizer formulation can also contain a surfactant, to reduce or prevent surface induced aggregation of the protein caused by atomization of the solution in forming the aerosol.

Formulations for use with a metered-dose inhaler device will generally comprise a finely divided powder containing the inventive compound suspended in a propellant with the aid of a surfactant. The propellant can be any conventional material employed for this purpose, such as a chlorofluorocarbon, a hydrochlorofluorocarbon, a hydrofluorocarbon, or a hydrocarbon, including trichlorofluoromethane, dichlorodifluoromethane, dichlorotetrafluoroethanol, and 1,1,1,2-tetrafluoroethane, or combinations thereof. Suitable surfactants include sorbitan trioleate and soya lecithin. Oleic acid can also be useful as a surfactant. (See, e.g., Bäckström et al., Aerosol drug formulations containing hydrofluoroalkanes and alkyl saccharides, U.S. Pat. No. 6,932,962).

Formulations for dispensing from a powder inhaler device will comprise a finely divided dry powder containing the inventive compound and can also include a bulking agent, such as lactose, sorbitol, sucrose, mannitol, trehalose, or xylitol in amounts which facilitate dispersal of the powder from the device, e.g., 50 to 90% by weight of the formulation.

Nasal delivery forms. In accordance with the present invention, intranasal delivery of the inventive composition of matter and/or pharmaceutical compositions is also useful, which allows passage thereof to the blood stream directly after administration to the inside of the nose, without the necessity for deposition of the product in the lung. Formulations suitable for intransal administration include those with dextran or cyclodextran, and intranasal delivery devices are known. (See, e.g, Freezer, Inhaler, U.S. Pat. No. 4,083,368).

Transdermal and transmucosal (e.g., Buccal) delivery forms). In some embodiments, the inventive composition is configured as a part of a pharmaceutically acceptable transdermal or transmucosal patch or a troche. Transdermal patch drug delivery systems, for example, matrix type transdermal patches, are known and useful for practicing some embodiments of the present pharmaceutical compositions. (E.g., Chien et al., Transdermal estrogen/progestin dosage unit, system and process, U.S. Pat. Nos. 4,906,169 and 5,023,084; Cleary et al., Diffusion matrix for transdermal drug administration and transdermal drug delivery devices including same, U.S. Pat. No. 4,911,916; Teillaud et al., EVA-based transdermal matrix system for the administration of an estrogen and/or a progestogen, U.S. Pat. No. 5,605,702; Venkateshwaran et al., Transdermal drug delivery matrix for coadministering estradiol and another steroid, U.S. Pat. No. 5,783,208; Ebert et al., Methods for providing testosterone and optionally estrogen replacement therapy to women, U.S. Pat. No. 5,460, 820). A variety of pharmaceutically acceptable systems for transmucosal delivery of therapeutic agents are also known in the art and are compatible with the practice of the present invention. (E.g., Heiber et al., Transmucosal delivery of macromolecular drugs, U.S. Pat. Nos. 5,346,701 and 5,516,523; Longenecker et al., Transmembrane formulations for drug administration, U.S. Pat. No. 4,994,439).

Buccal delivery of the inventive compositions is also useful. Buccal delivery formulations are known in the art for use with peptides. For example, known tablet or patch systems configured for drug delivery through the oral mucosa (e.g., sublingual mucosa), include some embodiments that comprise an inner layer containing the drug, a permeation enhancer, such as a bile salt or fusidate, and a hydrophilic polymer, such as hydroxypropyl cellulose, hydroxypropyl methylcellulose, hydroxyethyl cellulose, dextran, pectin, polyvinyl pyrrolidone, starch, gelatin, or any number of other polymers known to be useful for this purpose. This inner layer can have one surface adapted to contact and adhere to the moist mucosal tissue of the oral cavity and can have an opposing surface adhering to an overlying non-adhesive inert layer. Optionally, such a transmucosal delivery system can be in the form of a bilayer tablet, in which the inner layer also contains additional binding agents, flavoring agents, or fillers. Some useful systems employ a non-ionic detergent along with a permeation enhancer. Transmucosal delivery devices may be in free form, such as a cream, gel, or ointment, or may comprise a determinate form such as a tablet, patch or troche. For example, delivery of the inventive composition can be via a transmucosal delivery system comprising a laminated composite of, for example, an adhesive layer, a backing layer, a permeable membrane defining a reservoir containing the inventive composition, a peel seal disc underlying the membrane, one or more heat seals, and a removable release liner. (E.g., Ebert et al., Transdermal delivery system with adhesive overlay and peel seal disc, U.S. Pat. No. 5,662,925; Chang et al., Device for administering an active agent to the skin or mucosa, U.S. Pat. Nos. 4,849,224 and 4,983,395). These examples are merely illustrative of available transmucosal drug delivery technology and are not limiting of the present invention.

Dosages. The dosage regimen involved in a method for treating the above-described conditions will be determined by the attending physician, considering various factors which modify the action of drugs, e.g. the age, condition, body weight, sex and diet of the patient, the severity of any infection, time of administration and other clinical factors. Generally, the daily regimen should be in the range of 0.1-1000 micrograms of the inventive compound per kilogram of body weight, preferably 0.1-150 micrograms per kilogram.

WORKING EXAMPLES

The compositions described above can be prepared as described below. These examples are not to be construed in any way as limiting the scope of the present invention.

Example 1

Fc-L10-ShK[1-35] Mammalian Expression

Fc-L10-ShK[1-35], also referred to as "Fc-2xL-ShK [1-35]", an inhibitor of Kv1.3. A DNA sequence coding for the Fc region of human IgG1 fused in-frame to a linker sequence and a monomer of the Kv1.3 inhibitor peptide ShK [1-35] was constructed as described below. Methods for expressing and purifying the peptibody from mammalian cells (HEK 293 and Chinese Hamster Ovary cells) are disclosed herein.

Figure 13A:
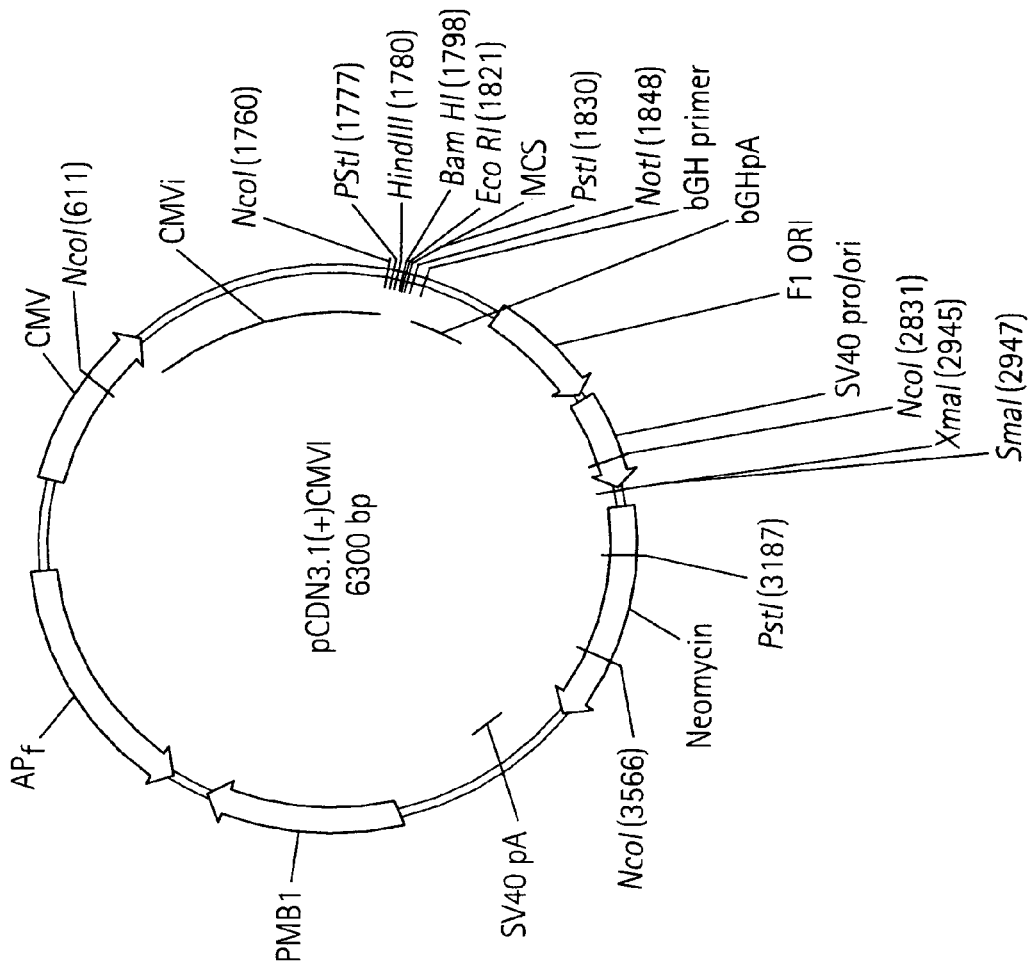
FIG. 13A is a circle diagram of mammalian expression vector pCDNA3.1 (+) CMVi.
Figure 13B:
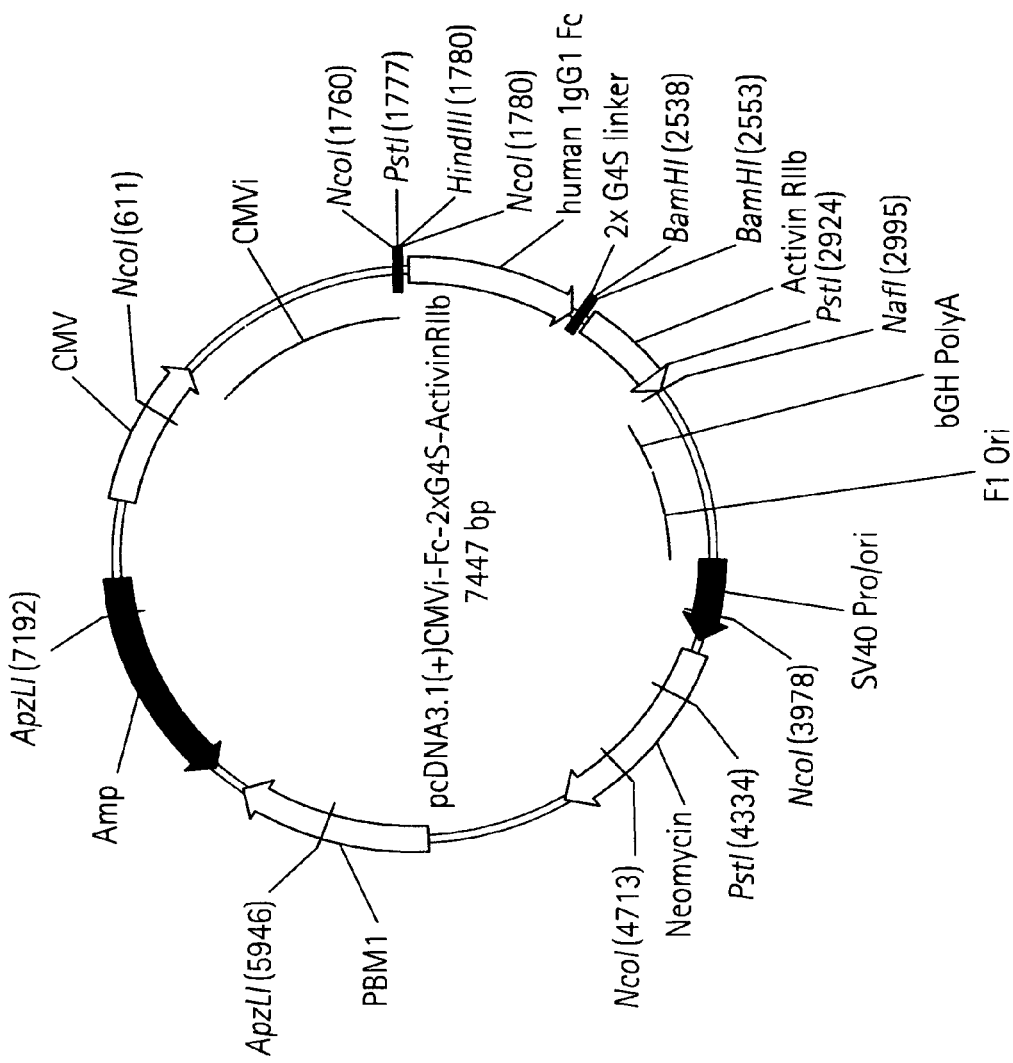
FIG. 13B is a circle diagram of mammalian expression vector pCDNA3.1(+)CMVi-Fc-2xG4S-Activin Rllb that contains a Fc region from human IgG1, a 10 amino acid linker and the activin Rllb gene.

The expression vector pcDNA3.1(+)CMVi (FIG. 13A) was constructed by replacing the CMV promoter between MluI and HindIII in pcDNA3.1(+) with the CMV promoter plus intron (Invitrogen). The expression vector pcDNA3.1(+) CMVi-hFc-ActivinRIIB (FIG. 13B) was generated by cloning a HindIII-NotI digested PCR product containing a 5' Kozak sequence, a signal peptide and the human Fc-linker— ActivinRIIB fusion protein with the large fragment of HindIII-NotI digested pcDNA3.1(+)CMVi. The nucleotide and amino acid sequence of the human IgG1 Fc region in pcDNA3.1(+)CMVi-hFc-ActivinRIIB is shown in FIG. 3. This vector also has a GGGGSGGGGS ("L10"; SEQ ID NO:79) linker split by a BamHI site thus enabling with the oligo below formation of the 10 amino acid linker between Fc and the ShK[1-35] peptide (see FIG. 14) for the final Fc-L10-ShK[1-35] nucleotide and amino acid sequence (FIG. 14 and SEQ ID NO: 77 and SEQ ID NO:78).

The Fc-L10-ShK[1-35] expression vector was constructing using PCR stategies to generate the full length ShK gene linked to a four glycine and one serine amino acid linker (lower case letters here indicate linker sequence of L-form amino acid residues) with two stop codons and flanked by BamHI and NotI restriction sites as shown below.

```
BamHI
GGATCCGGAGGAGGAGGAAGCCGCAGCTGCATCGACACCATCCCCAAGAGCCGCTGCACCGCCTTCCAG    //SEQ ID NO: 657
         g   g   g   g   s   R   S   C   I   D   T   I   P   K   S   R   C   T   A   F   Q    //SEQ ID NO: 658

TGCAAGCACAGCATGAAGTACCGCCTGAGCTTCTGCCGCAAGACCTGCGGCACCTGCTAATGAGCGGCCGC
 C   K   H   S   M   K   Y   R   L   S   F   C   R   K   T   C   G   T   C          NotI
```

Two oligos with the sequence as depicted below were used in a PCR reaction with Herculase™ polymerase (Stratagene) at 94° C.-30 sec, 50° C.-30 sec, and 72° C.-1 min for 30 cycles.

```
cat gga tcc gga gga gga gga agc    //SEQ ID NO: 659
cgc agc tgc atc gac acc atc ccc
aag agc cgc tgc acc gcc ttc cag
tgc aag cac cat gcg gcc gct cat tag cag gtg    //SEQ ID NO: 660
ccg cag gtc ttg cgg cag aag ctc
agg cgg tac ttc atg ctg tgc ttg
cac tgg aag g
```

The resulting PCR products were resolved as the 150 bp bands on a one percent agarose gel. The 150 bp PCR product was digested with BamHI and NotI (Roche) restriction enzymes and agarose gel purified by Gel Purification Kit (Qiagen). At the same time, the pcDNA3.1(+)CMVi-hFc-ActivinRIIB vector (FIG. 13B ) was digested with BamHI and NotI restriction enzymes and the large fragment was purified by Gel Purification Kit. The gel purified PCR fragment was ligated to the purified large fragment and transformed into XL-1blue bacteria (Stratagene). DNAs from transformed bacterial colonies were isolated and digested with BamHI and NotI restriction enzyme digestion and resolved on a one percent agarose gel. DNAs resulting in an expected pattern were submitted for sequencing. Although, analysis of several sequences of clones yielded a 100% percent match with the above sequence, only one clone was selected for large scaled plasmid purification. The DNA from Fc-2xL-ShK in pcDNA3.1(+)CMVi clone was resequenced to confirm the Fc and linker regions and the sequence was 100% identical to the predicted coding sequence, which is shown in FIG. 14.

HEK-293 cells used in transient transfection expression of Fc-2xL-ShK[1-35] in pcDNA3.1(+)CMVi protein were cultured in growth medium containing DMEM High Glucose (Gibco), 10% fetal bovine serum (FBS from Gibco) and 1× non-essential amino acid (NEAA from Gibco). 5.6 ug of Fc-2xL-ShK[1-35] in pcDNA3.1(+)CMVi plasmid that had been phenol/chloroform extracted was transfected into HEK-293 cells using Fugene 6 (Roche). The cells recovered for 24 hours, and then placed in DMEM High Glucose and 1×NEAA medium for 48 hours. The conditioned medium was concentrated 50× by running 30 ml through Centriprep YM-10 filter (Amicon) and further concentrated by a Centricon YM-10 (Amicon) filter. Various amounts of concentrated medium were mixed with an in-house 4× Loading Buffer (without B-mercaptoethanol) and electrophoresed on a Novex 4-20% tris-glycine gel using a Novex Xcell II apparatus at 101V/46 mA for 2 hours in a 5× Tank buffer solution (0.123 Tris Base, 0.96M Glycine) along with 10 ul of BenchMark Pre-Stained Protein ladder (Invitrogen). The gel was then soaked in Electroblot buffer (35 mM Tris base, 20% methanol, 192 mM glycine) for 30 minutes. A PVDF membrane from Novex (Cat. No. LC2002, 0.2 um pores size) was soaked in methanol for 30 seconds to activate the PVDF, rinsed with deionized water, and soaked in Electroblot buffer. The pre-soaked gel was blotted to the PVDF membrane using the XCell II Blot module according to the manufacturer instructions (Novex) at 40 mA for 2 hours. Then, the blot was first soaked in a 5% milk (Carnation) in Tris buffered saline solution pH 7.5 (TBS) for 1 hour at room temperature and incubated with 1:500 dilution in TBS with 0.1% Tween-20 (TBST Sigma) and 1% milk buffer of the HRP-conjugated murine anti-human Fc antibody (Zymed Laboratories Cat. no. 05-3320) for two hours shaking at room temperature. The blot was then washed three times in TBST for 15 minutes per wash at room temperature. The primary antibody was detected using Amersham Pharmacia Biotech's ECL western blotting detection reagents according to manufacturer's instructions. Upon ECL detection, the western blot analysis displayed the expected size of 66 kDa under non-reducing gel conditions (FIG. 24A).

AM1 CHOd-(Amgen Proprietary) cells used in the stable expression of Fc-L10-ShK[1-35] protein were cultured in AM1 CHOd-growth medium containing DMEM High Glucose, 10% fetal bovine serum, 1× hypoxantine/thymidine (HT from Gibco) and 1×NEAA. 6.5 ug of pcDNA3.1(+) CMVi-Fc-ShK plasmid was also transfected into AM1 CHOd-cells using Fugene 6. The following day, the transfected cells were plated into twenty 15 cm dishes and selected using DMEM high glucose, 10% FBS, 1×HT, 1×NEAA and Geneticin (800ug/ml G418 from Gibco) for thirteen days. Forty-eight surviving colonies were picked into two 24-well plates. The plates were allowed to grow up for a week and then replicated for freezing. One set of each plate was transferred to AM1 CHOd-growth medium without 10% FBS for 48 hours and the conditioned media were harvested. Western Blot analysis similar to the transient Western blot analysis with detection by the same anti-human Fc antibody was used to screen 15 ul of conditioned medium for expressing stable CHO clones. Of the 48 stable clones, more than 50% gave ShK expression at the expected size of 66 kDa. The BB6, BD5 and BD6 clones were selected with BD5 and BD6 as a backup to the primary clone BB6 (FIG. 24B).

The BB6 clone was scaled up into ten roller bottles (Corning) using AM1 CHOd-growth medium and grown to confluency as judged under the microscope. Then, the medium was exchanged with a serum-free medium containing to 50% DMEM high glucose and 50% Ham's F12 (Gibco) with 1×HT and 1×NEAA and let incubate for one week. The conditioned medium was harvested at the one-week incubation time, filtered through 0.45 μm filter (Corning) and frozen. Fresh serum-free medium was added and incubated for an additional week. The conditioned serum-free medium was harvested like the first time and frozen.

Approximately 4 L of conditioned medium was thawed in a water bath at room temperature. The medium was concentrated to about 450 ml using a Satorius Sartocon Polysulfon 10 tangential flow ultra-filtration cassette (0.1 m$^2$) at room temperature. The retentate was then filtered through a 0.22 μm cellulose acetate filter with a pre-filter. The retentate was then loaded on to a 5 ml Amersham HiTrap Protein A column at 5 ml/min 7° C., and the column was washed with several column volumes of Dulbecco's phosphate buffered saline without divalent cations (PBS) and sample was eluted with a step to 100 mM glycine pH 3.0. The protein A elution pool (approximately 9 ml) was diluted to 50 ml with water and loaded on to a 5 ml Amersham HiTrap SP-HP column in S-Buffer A (20 mM NaH$_2$PO$_4$, pH 7.0) at 5 ml/min and 7° C. The column was then washed with several column volumes S-Buffer A, and then developed using a linear gradient from 25% to 75% S-Buffer B (20 mM NaH$_2$PO$_4$, 1 M NaCl, pH 7.0) at 5 ml/min followed by a step to 100% S-Buffer B at 7° C. Fractions were then analyzed using a Coomassie brilliant blue stained tris-glycine 4-20% SDS-PAGE, and the fractions containing the desired product were pooled based on these data. The pooled material was then concentrated to about 3.4 ml using a Pall Life Sciences Macrosep 10K Omega centrifugal ultra-filtration device and then filtered though a Costar 0.22 μm cellulose acetate syringe filter.

A spectral scan was then conducted on 10 μl of the filtered material diluted in 700 μl PBS using a Hewlett Packard 8453 spectrophotometer (FIG. 26A). The concentration of the filtered material was determined to be 5.4 mg/ml using a calculated molecular mass of 32,420 g/mol and extinction coefficient of 47,900 M$^{-1}$ cm$^{-1}$. The purity of the filtered material was then assessed using a Coomassie brilliant blue stained tris-glycine 4-20% SDS-PAGE (FIG. 26B). The endotoxin level was then determined using a Charles River Laboratories Endosafe-PTS system (0.05-5 EU/ml sensitivity) using a 108-fold dilution of the sample in PBS yielding a result of <1 EU/mg protein. The macromolecular state of the product was then determined using size exclusion chromatography on 20 μg of the product injected on to a Phenomenex BioSep SEC 3000 column (7.8×300 mm) in 50 mM NaH$_2$PO$_4$, 250 mM NaCl, pH 6.9 at 1 ml/min observing the absorbance at 280 nm (FIG. 26C). The product was then subject to mass spectral analysis by diluting 1 μl of the sample into 10 μl of sinapinic acid (10 mg per ml in 0.05% trifluroacetic acid, 50% acetonitrile). The resultant solution (1 μl) was spotted onto a MALDI sample plate. The sample was allowed to dry before being analyzed using a Voyager DE-RP time-of-flight mass spectrometer equipped with a nitrogen laser (337 nm, 3 ns pulse). The positive ion/linear mode was used, with an accelerating voltage of 25 kV. Each spectrum was produced by accumulating data from ~200 laser shots. External mass calibration was accomplished using purified proteins of known molecular masses (FIG. 26D) and confirmed (within experimental error) the integrity of the purified peptibody. The product was then stored at −80° C.

Purified Fc-L10-ShK[1-35] potently blocked human Kv1.3 (FIG. 30A and FIG. 30B) as determined by electrophysiology (see Example 36). The purified Fc-L10-ShK[1-35] molecule also blocked T cell proliferation (FIG. 36A and FIG. 36B) and production of the cytokines IL-2 (FIG. 35A and FIG. 37A) and IFN-g (FIG. 35B and FIG. 37B).

Example 2

Fc-L-ShK[2-35] Mammalian Expression

A DNA sequence coding for the Fc region of human IgG1 fused in-frame to a monomer of the Kv1.3 inhibitor peptide ShK[2-35] was constructed using standard PCR technology. The ShK[2-35] and the 5, 10, or 25 amino acid linker portion of the molecule were generated in a PCR reaction using the original Fc-2xL-ShK[1-35] in pcDNA3.1(+)CMVi as a template (Example 1, FIG. 14). All ShK constructs should have the following amino acid sequence of

SCIDTIPKSRCTAFQCKHSMKYRLSFCRKTCGTC (SEQ ID NO: 92)

with the first amino acid of the wild-type sequence deleted.

The sequences of the primers used to generate Fc-L5-ShK[2-35], also referred to as "Fc-1xL-ShK[2-35]", are shown below:

```
cat gga tcc agc tgc atc gac acc    //SEQ ID NO: 661
atc;

cat gcg gcc gct cat tag c;         //SEQ ID NO: 662
```

The sequences of the primers used to generate Fc-L10-ShK[2-35], also referred to as "Fc-2xL-ShK[2-35]" are shown below:

```
cat gga tcc gga gga gga gga agc    //SEQ ID NO: 663
agc tgc a;

cat gcg gcc gct cat tag cag gtg c; //SEQ ID NO: 664
```

The sequences of the primers used to generate Fc-L25-ShK[2-35], also referred to as "Fc-5xL-ShK[2-35]", are shown below:

```
cat gga tcc ggg ggt ggg ggt tct    //SEQ ID NO: 665
ggg ggt ggg ggt tct gga gga gga
gga agc gga gga gga gga agc agc
tgc a;

cat gcg gcc gct cat tag cag gtg c; //SEQ ID NO: 666
```

The PCR products were digested with BamHI and NotI (Roche) restriction enzymes and agarose gel purified by Gel Purification Kit. At the same time, the pcDNA3.1(+)CMVi-hFc-ActivinRIIB vector was digested with BamHI and NotI restriction enzymes and the large fragment was purified by Gel Purification Kit. Each purified PCR product was ligated to the large fragment and transformed into XL-1blue bacteria. DNAs from transformed bacterial colonies were isolated and subjected to BamHI and NotI restriction enzyme digestions and resolved on a one percent agarose gel. DNAs resulting in an expected pattern were submitted for sequencing. Although, analysis of several sequences of clones yielded a 100% percent match with the above sequence, only one clone was selected for large scaled plasmid purification. The DNA from this clone was resequenced to confirm the Fc and linker regions and the sequence was 100% identical to the expected sequence.

Figure 13C:
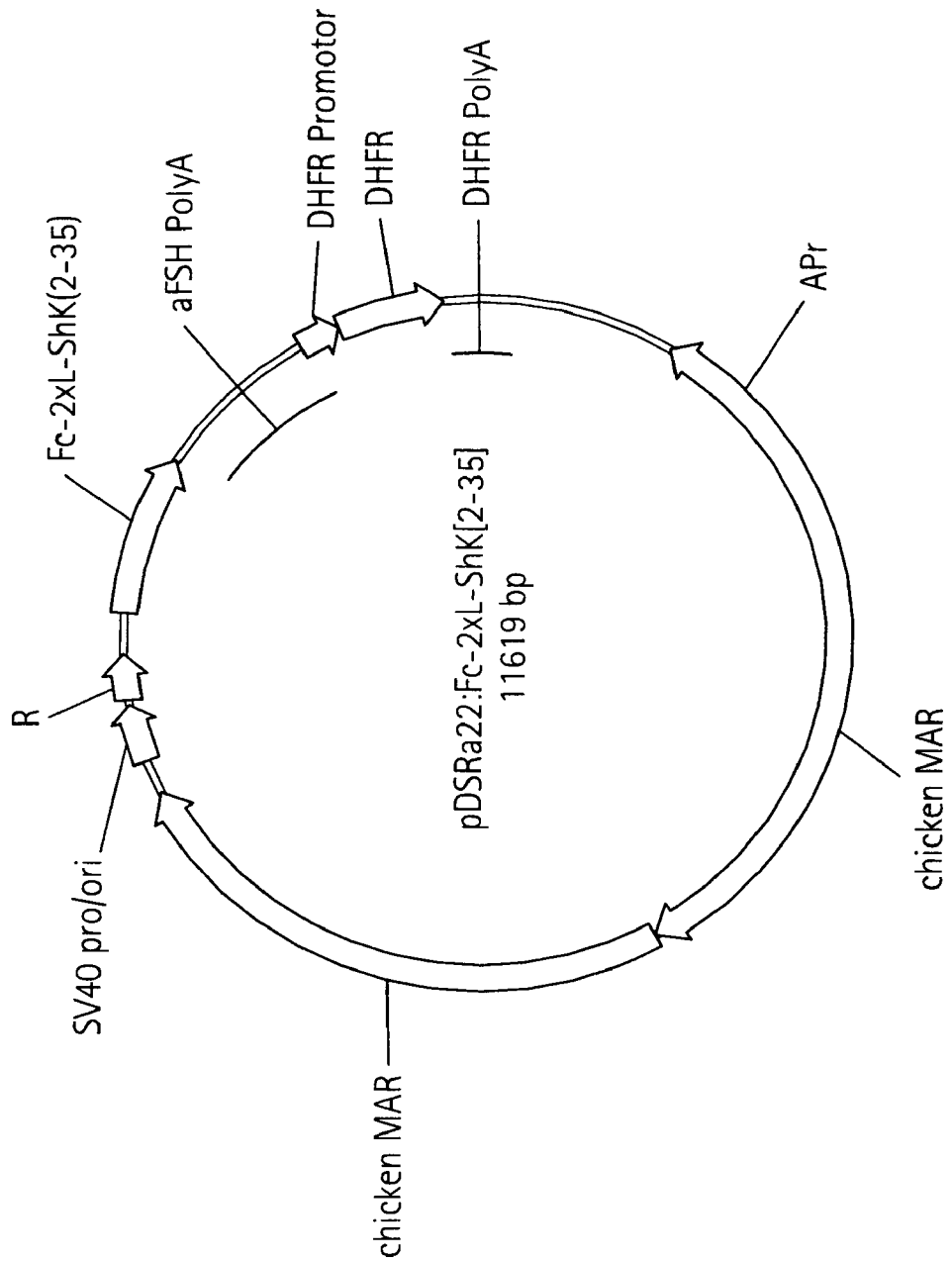
FIG. 13C is a circle diagram of the CHO expression vector pDSRa22 containing the Fc-L10-ShK[2-35] coding sequence.

Plasmids containing the Fc-1xL-Shk[2-35], Fc-2xL-Shk[2-35] and Fc-5xL-Shk[2-35] inserts in pcDNA3.1 (+)CMVi vector were digested with Xba1 and Xho1 (Roche) restriction enzymes and gel purified. The inserts were individually ligated into Not1 and SalI (Roche) digested pDSRα-22 (Amgen Proprietary) expression vector. Integrity of the resulting constructs were confirmed by DNA sequencing. The final plasmid DNA expression vector constructs were pDSRα-22-Fc-1xL-Shk[2-35], pDSRα-22-Fc-2xL-Shk[2-35] (FIG. 13C and FIG. 15) and pDSRα-22-Fc-5xL-Shk[2-35] (FIG. 16) and contained 5, 10 and 25 amino acid linkers, respectively.

Twenty-four hours prior to transfection, 1.2e7 AM-1/D CHOd-(Amgen Proprietary) cells were plated into a T-175 cm sterile tissue culture flask, to allow 70-80% confluency on the day of transfection. The cells had been maintained in the AM-1/D CHOd-culture medium containing DMEM High Glucose, 5% FBS, 1× Glutamine Pen/Strep (Gibco), 1×HT, 1×NEAA's and 1× sodium pyruvate (Gibco). The following day, eighteen micrograms of each of the linearized pDSRα22:Fc-1xL-ShK[2-35], pDSRα22:Fc-2xL-ShK[2-35] and pDSRα22:Fc-5xL-ShK[2-35] (RDS's # 20050037685, 20050053709, 20050073295) plasmids were mixed with 72 μg of linearized Selexis MAR plasmid and pPAGO1 (RDS 20042009896) and diluted into 6 ml of Opti-MEM in a 50 ml conical tube and incubate for five minutes. LF2000 (210 μl) was added to 6 ml of OptiMEM and incubated for five minutes. The diluted DNA and LF2000 were mixed together and incubated for 20 minutes at room temperature. In the meantime, the cells were washed one time with PBS and then 30 ml OptiMEM without antibiotics were added to the cells. tThe OptiMEM was aspirated off, and the cells were incubated with 12 ml of DNA/LF2000 mixture for 6 hours or overnight in the 37° C. incubator with shaking. Twenty-four hours post transfection, the cells were split 1:5 into AM-1/D CHOd-culture medium and at differing dilutions for colony selection. Seventy-two hours post transfection, the cell medium was replaced with DHFR selection medium containing 10% Dialyzed FBS (Gibco) in DMEM High Glucose, plus 1× Glutamine Pen/Strep, 1×NEAA's and 1×Na Pyr to allow expression and secretion of protein into the cell medium. The selection medium was changed two times a week until the colonies are big enough to pick. The pDSRa22 expression vector contains a DHFR expression cassette, which allows transfected cells to grow in the absence of hypoxanthine and thymidine. The five T-175 pools of the resulting colonies were scaled up into roller bottles and cultured under serum free conditions. The conditioned media were harvested and replaced at one-week intervals. The resulting 3 liters of conditioned medium was filtered through a 0.45 um cellulose acetate filter (Corning, Acton, Mass.) and transferred to Protein Chemistry for purification. As a backup, twelve colonies were selected from the 10 cm plates after 10-14 days on DHFR selection medium and expression levels evaluated by western blot using HRP conjugated anti human IgGFc as a probe. The three best clones expressing the highest level of each of the different linker length Fc-L-ShK[2-35] fusion proteins were expanded and frozen for future use.

Purification of Fc-L10-ShK(2-35). Approximately 1 L of conditioned medium was thawed in a water bath at room temperature. The medium was loaded on to a 5 ml Amersham HiTrap Protein A column at 5 ml/min 7° C., and the column was washed with several column volumes of Dulbecco's phosphate buffered saline without divalent cations (PBS) and sample was eluted with a step to 100 mM glycine pH 3.0. The protein A elution pool (approximately 8.5 ml) combined with 71 µl 3 M sodium acetate and then diluted to 50 ml with water. The diluted material was then loaded on to a 5 ml Amersham HiTrap SP-HP column in S-Buffer A (20 mM $NaH_2PO_4$, pH 7.0) at 5 ml/min 7° C. The column was then washed with several column volumes S-Buffer A, and then developed using a linear gradient from 0% to 75% S-Buffer B (20 mM $NaH_2PO_4$, 1 M NaCl, pH 7.0) at 5 ml/min followed by a step to 100% S-Buffer B at 7° C. Fractions were then analyzed using a Coomassie brilliant blue stained tris-glycine 4-20% SDS-PAGE, and the fractions containing the desired product were pooled based on these data. The pooled material was then filtered through a 0.22 µm cellulose acetate filter and concentrated to about 3.9 ml using a Pall Life Sciences Macrosep 10K Omega centrifugal ultra-filtration device. The concentrated material was then filtered though a Pall Life Sciences Acrodisc with a 0.22 µm, 25 mm Mustang E membrane at 2 ml/min room temperature. A spectral scan was then conducted on 10 µl of the filtered material diluted in 700 µl PBS using a Hewlett Packard 8453 spectrophotometer (FIG. 27E). The concentration of the filtered material was determined to be 2.76 mg/ml using a calculated molecular mass of 30,008 g/mol and extinction coefficient of 36,900 $M^{-1}$ $cm^{-1}$. Since material was found in the permeate, repeated concentration step on the permeate using a new Macrosep cartridge. The new batch of concentrated material was then filtered though a Pall Life Sciences Acrodisc with a 0.22 µm, 25 mm Mustang E membrane at 2 ml/min room temperature. Both lots of concentrated material were combined into one pool.

A spectral scan was then conducted on 10 µL of the combined pool diluted in 700 µl PBS using a Hewlett Packard 8453 spectrophotometer. The concentration of the filtered material was determined to be 3.33 mg/ml using a calculated molecular mass of 30,008 g/mol and extinction coefficient of 36,900 $M^{-1}$ $cm^{-1}$. The purity of the filtered material was then assessed using a Coomassie brilliant blue stained tris-glycine 4-20% SDS-PAGE (FIG. 27A). The endotoxin level was then determined using a Charles River Laboratories Endosafe-PTS system (0.05-5 EU/ml sensitivity) using a 67-fold dilution of the sample in PBS yielding a result of <1 EU/mg protein. The macromolecular state of the product was then determined using size exclusion chromatography on 50 µg of the product injected on to a Phenomenex BioSep SEC 3000 column (7.8×300 mm) in 50 mM $NaH_2PO_4$, 250 mM NaCl, pH 6.9 at 1 ml/min observing the absorbance at 280 nm (FIG. 27B). The product was then subject to mass spectral analysis by diluting 1 µl of the sample into 10 µl of sinapinic acid (10 mg per ml in 0.05% trifluroacetic acid, 50% acetonitrile). The resultant solution (1 µl) was spotted onto a MALDI sample plate. The sample was allowed to dry before being analyzed using a Voyager DE-RP time-of-flight mass spectrometer equipped with a nitrogen laser (337 nm, 3 ns pulse). The positive ion/linear mode was used, with an accelerating voltage of 25 kV. Each spectrum was produced by accumulating data from ~200 laser shots. External mass calibration was accomplished using purified proteins of known molecular masses (FIG. 27F) and the experiment confirmed the itegrity of the peptibody, within experimental error. The product was then stored at –80° C.

FIG. 31B shows that purified Fc-L10-ShK[2-35] potently blocks human Kv1.3 current (electrophysiology was done as described in Example 36). The purified Fc-L10-ShK[2-35] molecule also blocked IL-2 (FIG. 64A and FIG. 64B) and IFN-g (FIG. 65A and FIG. 65B) production in human whole blood, as well as, upregulation of CD40L (FIG. 66A and FIG. 66B) and IL-2R (FIG. 67A and FIG. 67B) on T cells.

Purification of Fc-L5-ShK(2-35). Approximately 1 L of conditioned medium was loaded on to a 5 ml Amersham HiTrap Protein A column at 5 ml/min 7° C., and the column was washed with several column volumes of Dulbecco's phosphate buffered saline without divalent cations (PBS) and sample was eluted with a step to 100 mM glycine pH 3.0. The protein A elution pool (approximately 9 ml) combined with 450 µl 1 M tris HCl pH 8.5 followed by 230 µl 2 M acetic acid and then diluted to 50 ml with water. The pH adjusted material was then filtered through a 0.22 µm cellulose acetate filter and loaded on to a 5 ml Amersham HiTrap SP-HP column in S-Buffer A (20 mM $NaH_2PO_4$, pH 7.0) at 5 ml/min 7° C. The column was then washed with several column volumes S-Buffer A, and then developed using a linear gradient from 0% to 75% S-Buffer B (20 mM $NaH_2PO_4$, 1 M NaCl, pH 7.0) at 5 ml/min followed by a step to 100% S-Buffer B at 7° C. Fractions were then analyzed using a Coomassie brilliant blue stained tris-glycine 4-20% SDS-PAGE, and the fractions containing the desired product were pooled based on these data. The pooled material was then concentrated to about 5.5 ml using a Pall Life Sciences Macrosep 10K Omega centrifugal ultra-filtration device. The concentrated material was then filtered though a Pall Life Sciences Acrodisc with a 0.22 µm, 25 mm Mustang E membrane at 2 ml/min room temperature.

A spectral scan was then conducted on 10 µl of the combined pool diluted in 700 µl PBS using a Hewlett Packard 8453 spectrophotometer (FIG. 27G). The concentration of the filtered material was determined to be 4.59 mg/ml using a calculated molecular mass of 29,750 g/mol and extinction coefficient of 36,900 $M^{-1}$ $cm^{-1}$. The purity of the filtered material was then assessed using a Coomassie brilliant blue stained tris-glycine 4-20% SDS-PAGE (FIG. 27C). The endotoxin level was then determined using a Charles River Laboratories Endosafe-PTS system (0.05-5 EU/ml sensitivity) using a 92-fold dilution of the sample in Charles Rivers Endotoxin Specific Buffer BG120 yielding a result of <1 EU/mg protein. The macromolecular state of the product was then determined using size exclusion chromatography on 50 µg of the product injected on to a Phenomenex BioSep SEC 3000 column (7.8×300 mm) in 50 mM $NaH_2PO_4$, 250 mM NaCl, pH 6.9 at 1 ml/min observing the absorbance at 280 nm (FIG. 27H). The product was then subject to mass spectral analysis by diluting 1 µl of the sample into 10 µl of sinapinic acid (10 mg per ml in 0.05% trifluroacetic acid, 50% acetonitrile). The resultant solution (1 µl) was spotted onto a MALDI sample plate. The sample was allowed to dry before being analyzed using a Voyager DE-RP time-of-flight mass spectrometer equipped with a nitrogen laser (337 nm, 3 ns pulse). The positive ion/linear mode was used, with an accelerating voltage of 25 kV. Each spectrum was produced by accumulating data from ~200 laser shots. External mass calibration was accomplished using purified proteins of known molecular masses (FIG. 27I) and confirmed the integrity of the peptibody, within experimental error. The product was then stored at –80° C.

FIG. 31C shows that purified Fc-L5-ShK[2-35] is highly active and blocks human Kv1.3 as determined by whole cell patch clamp electrophysiology (see Example 36).

Purification of Fc-L25-ShK(2-35). Approximately 1 L of conditioned medium was loaded on to a 5 ml Amersham HiTrap Protein A column at 5 ml/min 7° C., and the column was washed with several column volumes of Dulbecco's phosphate buffered saline without divalent cations (PBS) and sample was eluted with a step to 100 mM glycine pH 3.0. The protein A elution pool (approximately 9.5 ml) combined with 119 μl 3 M sodium acetate and then diluted to 50 ml with water. The pH adjusted material was then loaded on to a 5 ml Amersham HiTrap SP-HP column in S-Buffer A (20 mM NaH$_2$PO$_4$, pH 7.0) at 5 ml/min 7° C. The column was then washed with several column volumes S-Buffer A, and then developed using a linear gradient from 0% to 75% S-Buffer B (20 mM NaH$_2$PO$_4$, 1 M NaCl, pH 7.0) at 5 ml/min followed by a step to 100% S-Buffer B at 7° C. Fractions containing the main peak from the chromatogram were pooled and filtered through a 0.22 μm cellulose acetate filter.

A spectral scan was then conducted on 20 μl of the combined pool diluted in 700 μl PBS using a Hewlett Packard 8453 spectrophotometer FIG. 27J. The concentration of the filtered material was determined to be 1.40 mg/ml using a calculated molecular mass of 31,011 g/mol and extinction coefficient of 36,900 M$^{-1}$ cm$^{-1}$. The purity of the filtered material was then assessed using a Coomassie brilliant blue stained tris-glycine 4-20% SDS-PAGE (FIG. 27D). The endotoxin level was then determined using a Charles River Laboratories Endosafe-PTS system (0.05-5 EU/ml sensitivity) using a 28-fold dilution of the sample in Charles Rivers Endotoxin Specific Buffer BG120 yielding a result of <1 EU/mg protein. The macromolecular state of the product was then determined using size exclusion chromatography on 50 μg of the product injected on to a Phenomenex BioSep SEC 3000 column (7.8×300 mm) in 50 mM NaH$_2$PO$_4$, 250 mM NaCl, pH 6.9 at 1 ml/min observing the absorbance at 280 nm (FIG. 27K). The product was then subject to mass spectral analysis by diluting 1 μl of the sample into 10 μl of sinapinic acid (10 mg per ml in 0.05% trifluroacetic acid, 50% acetonitrile). The resultant solution (1 μl) was spotted onto a MALDI sample plate. The sample was allowed to dry before being analyzed using a Voyager DE-RP time-of-flight mass spectrometer equipped with a nitrogen laser (337 nm, 3 ns pulse). The positive ion/linear mode was used, with an accelerating voltage of 25 kV. Each spectrum was produced by accumulating data from ~200 laser shots. External mass calibration was accomplished using purified proteins of known molecular masses (FIG. 27L) and this confirmed the itegrity of the peptibody, within experimental error. The product was then stored at −80° C.

Purified Fc-L25-ShK[2-35] inhibited human Kv1.3 with an IC$_{50}$ of ~150 pM by whole cell patch clamp electrophysiology on HEK293/Kv1.3 cells (Example 36).

Example 3

Fc-L-ShK[1-35] Bacterial Expression

Description of bacterial peptibody expression vectors and procedures for cloning and expression of peptibodies. The cloning vector used for bacterial expression (Examples 3-30) is based on pAMG21 (originally described in U.S. Patent 2004/0044188). It has been modified in that the kanamycin resistance component has been replaced with ampicillin resistance by excising the DNA between the unique BstBI and NsiI sites of the vector and replacing with an appropriately digested PCR fragment bearing the beta-lactamase gene using PCR primers CCA ACA CAC TTC GAA AGA CGT TGA TCG GCA C (SEQ ID NO: 667) and CAC CCA ACA ATG CAT CCT TAA AAA AAT TAC GCC C (SEQ ID NO: 668) with pUC19 DNA as the template source of the beta-lactamase gene conferring resistance to ampicillin. The new version is called pAMG21ampR.

Figure 11D:
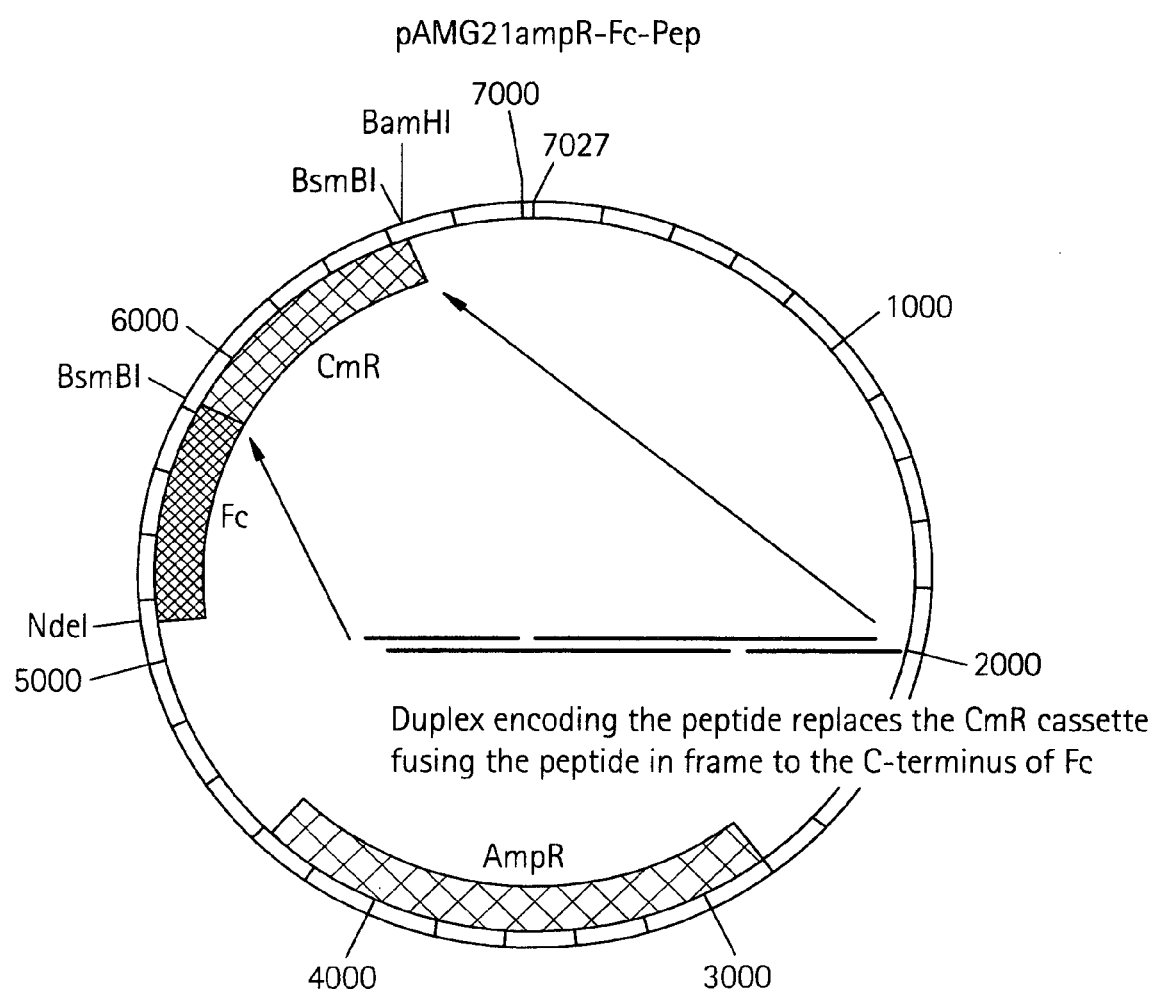
FIG. 11D shows a circle diagram of a peptibody bacterial expression vector pAMG21ampR-Fc-pep having a chloramphenicol acetyltransferase gene (cat; "CmR" site) that is replaced with the peptide-linker sequence.

Description of cloning vector pAMG21ampR-Fc-Pep used in examples 3 to 30, excluding 15 and 16. FIG. 11A-C and FIG. 11D (schematic diagram) show the ds-DNA that has been added to the basic vector pAMG21ampR to permit the cloning of peptide fusions to the C-terminus of the Fc gene. The DNA has been introduced between the unique NdeI and BamHI sites in the pAMG21ampR vector. This entire region of DNA is shown in FIG. 11A-C. The coding region for Fc extends from nt 5134 to 5817 and the protein sequence appears below the DNA sequence. This is followed in frame by a glyX5 linker (nt's 5818-5832). A BsmBI site (GAGACG) spans nt's 5834-5839. DNA cleavage occurs between nt's 5828 and 5829 on the upper DNA strand and between nt's 5832 and 5833 on the lower DNA strand. Digestion creates 4 bp cohesive termini as shown here. The BsmBI site is underlined.

```
AGGTGG      TGGTTGAGACG    SEQ ID NO: 683

TCCACCACCA       ACTCTGC    SEQ ID NO: 684
```

A second BsmBI site occurs at nt's 6643 through 6648; viz., CGTCTC. DNA cleavage occurs between nt's 6650 and 6651 on the upper strand and between 6654 and 6655 on the lower strand.

```
CGTCTCT        TAAGGATCCG   SEQ ID NO: 685

GCAGAGAATTC         CTAGGC   SEQ ID NO: 686
```

Between the two BsmBI sites is a dispensable chloramphenicol resistance cassette constitutively expressing chloramphenicol acetyltransferase (cat gene). The cat protein sequence:

```
                                              //SEQ ID NO: 1337
  1 MEKKITGYTT VDISQWHRKE HFEAFQSVAQ CTYNQTVQLD
    ITAFLKTVKK

51 NKHKFYPAFI HILARLMNAH PEFRMAMKDG ELVIWDSVHP
    CYTVFHEQTE

101 TFSSLWSEYH DDFRQFLHIY SQDVACYGEN LAYFPKGFIE
    NMFFVSANPW

151 VSFTSFDLNV ANMDNFFAPV FTMGKYYTQG DKVLMPLAIQ
    VHHAVCDGFH

201 VGRMLNELQQ YCDEWQGGA
``` is shown in FIG. 11A-C and extends from nt's 5954 to 6610. The peptide encoding duplexes in each example (except Examples 15 and 16) bear cohesive ends complementary to those presented by the vector.

Figure 12D:
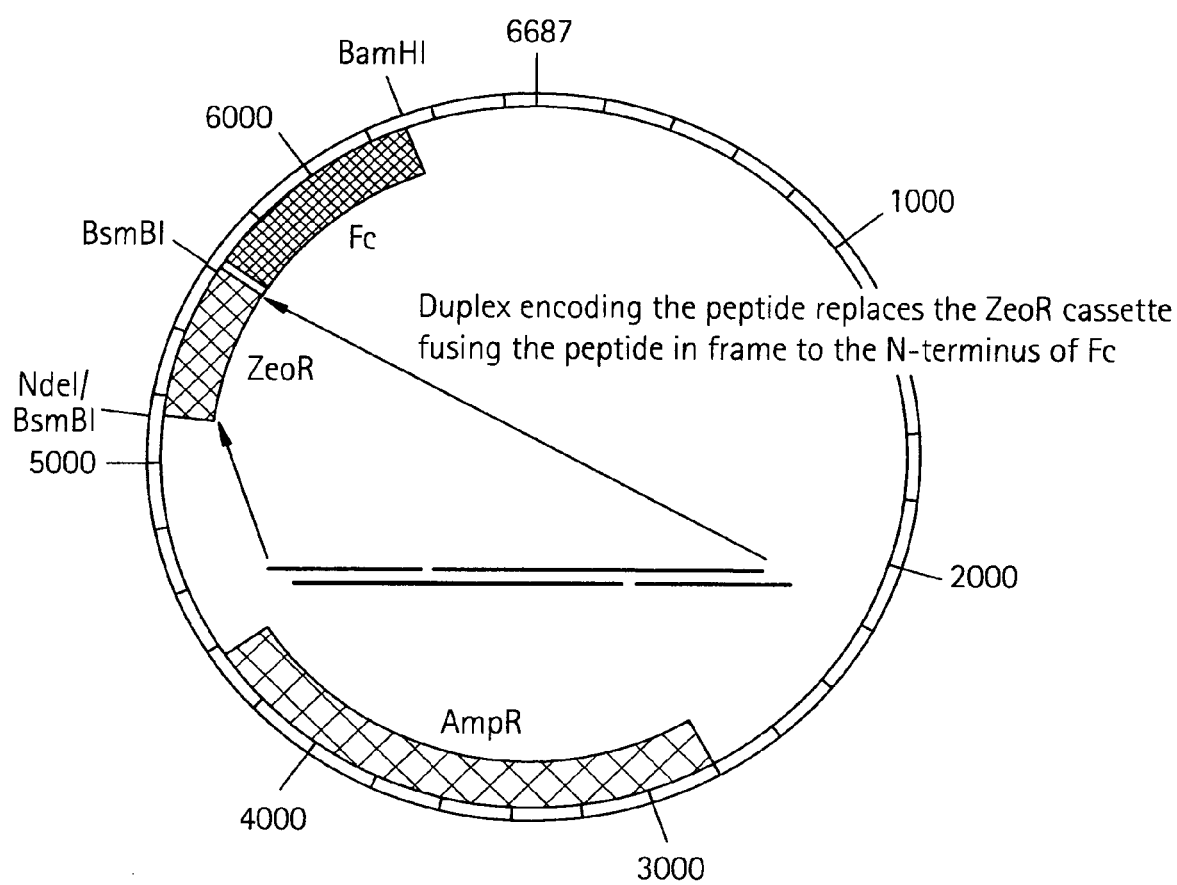
FIG. 12D shows a circle diagram of a peptibody bacterial expression vector having a zeocin resistance (ble; "ZeoR") site that is replaced with the peptide-linker sequence.

Description of the cloning vector pAMG21ampR-Pep-Fc used in examples 15 and 16. FIG. 12A-C, and the schematic diagram in FIG. 12D, shows the ds-DNA sequence that has been added to the basic vector pAMG21ampR to permit the cloning of peptide fusions to the N-terminus of the Fc gene. The DNA has been introduced between the unique NdeI and BamHI sites in the pAMG21ampR vector. The coding region for Fc extends from nt 5640 to 6309 and the protein sequence appears below the DNA sequence. This is preceded in frame by a glyX5 linker (nt's 5614-5628). A BsmBI site spans nt's 5138 to 5143; viz., GAGACG. The cutting occurs between nt's 5132 and 5133 on the upper DNA strand and between 5136 and 5137 on the lower DNA strand.

Digestion creates 4 bp cohesive termini as shown. The BsmBI site is underlined.

```
  AATAACA        TATGCGAGACG    SEQ ID NO: 687

TTATTGTATAC    GCTCTGC        SEQ ID NO: 688
```

A second BsmBI site occurs at nt's 5607 through 5612; viz., CGTCTC. Cutting occurs between nt's 5613 and 5614 on the upper strand and between 5617 and 5618 on the lower strand.

```
  CGTCTCA        GGTGGTGGT      SEQ ID NO: 689

GCAGAGTCCAC    CACCA
```

Between the BsmBI sites is a dispensable zeocin resistance cassette constitutively expressing the Shigella ble protein. The ble protein sequence:

```
                                         //SEQ ID NO: 1338
  1 MAKLTSAVPV LTARDVAGAV EFWTDRLGFS RDFVEDDFAG
    VVRDDVTLFI

51 SAVQDQVVPD NTLAWVWVRG LDELYAEWSE VVSTNFRDAS
    GPAMTEIGEQ

101 PWGREFALRD PAGNCVHFVA EEQD
``` is shown extending from nt's 5217 to 5588 in FIG. 12A-C. The peptide encoding duplexes in Examples 15 and 16 bear cohesive ends complementary to those presented by the vector.

Description of the cloning vector pAMG21ampR-Pep-Fc used in Examples 52 and 53. FIG. 12E-F shows the ds-DNA sequence that has been added to the basic vector pAMG21ampR to permit the cloning of peptide fusions to the N-terminus of the Fc gene in which the first two codons of the peptide are to be met-gly. The DNA has been introduced between the unique NdeI and BamHI sites in the pAMG21ampR vector. The coding region for Fc extends from nt 5632 to 6312 and the protein sequence appears below 5146; viz., GAGACG. The cutting occurs between nt's 5135 and 5136 on the upper DNA strand and between 5139 and 5140 on the lower DNA strand.

Digestion creates 4 bp cohesive termini as shown. The BsmBI site is underlined.

```
 AATAACATAT      GGGTCGAGACG    SEQ ID NO: 1344

SEQ ID NO: 1343

TTATTGTATACCCA  GCTCTGC        SEQ ID NO: 1345
```

A second BsmBI site occurs at nt's 5607 through 5612; viz., CGTCTC. Cutting occurs between nt's 5613 and 5614 on the upper strand and between 5617 and 5618 on the lower strand.

```
 CGTCTCA         GGTGGTGGT      SEQ ID NO: 1346

GCAGAGTCCAC     CACCA
```

Between the BsmBI sites is a dispensable zeocin resistance cassette constitutively expressing the Shigella ble protein. The ble protein sequence, as described above, is shown extending from nt's 5220 to 5591. The peptide encoding duplexes in Examples 52 and 53 herein below bear cohesive ends complementary to those presented by the vector.

For Examples 3 to 30 for which all are for bacterial expression, cloned peptide sequences are all derived from the annealing of oligonucleotides to create a DNA duplex that is directly ligated into the appropriate vector. Two oligos suffice for Example 20, four are required for all other examples. When the duplex is to be inserted at the N-terminus of Fc (see, Examples 15, 16, 52, and 53 herein) the design is as follows with the ordinal numbers matching the listing of oligos in each example:

```
              First Oligo                    Second Oligo
      TATG ─────────────────      ──────────────────────
           ──────────────────  ──────────────────────── CCAC
              Fourth Oligo                   Third Oligo
```

When the duplex is to be inserted at the C-terminus of Fc (Examples 3, 4, 5, 10, 11, 12, 13, and 30) the design is as follows:

```
              First Oligo                    Second Oligo
      TGGT ─────────────────      ──────────────────────
           ──────────────────  ──────────────────────── ATTC
              Fourth Oligo                   Third Oligo
``` the DNA sequence. This is preceded in frame by a glyX5 linker (nt's 5617-5631). A BsmBI site spans nt's 5141 to All remaining examples have the duplex inserted at the C-terminus of Fc and utilize the following design.

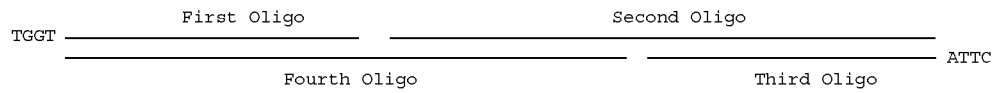

No kinasing step is required for the phosphorylation of any of the oligos. A successful insertion of a duplex results in the replacement of the dispensable antibiotic resistance cassette (Zeocin resistance for pAMG21ampR-Pep-Fc and chloramphenicol resistance for pAMG21ampR-Fc-Pep). The resulting change in phenotype is useful for discriminating recombinant from nonrecombinant clones.

The following description gives the uniform method for carrying out the cloning of all 30 bacterially expressed recombinant proteins exemplified herein. Only the set of oligonucleotides and the vector are varied. These spefications are given below in each example.

An oligonucleotide duplex containing the coding region for a given peptide was formed by annealing the oligonucleotides listed in each example. Ten picomoles of each oligo was mixed in a final volume of 10 µl containing 1× ligation buffer along with 0.3 µg of appropriate vector that had been previously digested with restriction endonuclease BsmBI.

the duplex insert. Plasmid preparations were obtained and the recombinant insert was verified by DNA sequencing. Half liter cultures of a sequence confirmed construct were grown in Terrific Broth, expression of the peptibody was induced by addition of N-(3-oxo-hexanoyl)-homoserine lactone at 50 ng/ml and after 4-6 hours of shaking at 37 C the cells were centrifuged and the cell paste stored at −20 C.

The following gives for each example the cloning vector and the set of oligonucleotides used for constructing each fusion protein. Also shown is a DNA/protein map.

Bacterial expression of Fc-L-ShK[1-35] inhibitor of Kv1.3. The methods to clone and express the peptibody in bacteria are described above. The vector used was pAMG21ampR-Fc-Pep and the oligos listed below were used to generate a duplex (see below) for cloning and expression in bacteria of Fc-L-ShK[1-35].

Oligos used to form the duplex:

```
TGGTTCCGGTGGTGGTGGTTCCCGTTCCTGCATCGACACCAT;                                    //SEQ ID NO: 669

CCCGAAATCCCGTTGCACCGCTTTCCAGTGCAAACACTCCATGAAATACCGTCTGTCCTTCTGCCGTAAAACC      //SEQ ID NO: 670
TGCGGTACCTGC;

CTTAGCAGGTACCGCAGGTTTTACGGCAGAAGGACAGACGGT;                                    //SEQ ID NO: 671

ATTTCATGGAGTGTTTGCACTGGAAAGCGGTGCAACGGGATTTCGGGATGGTGTCGATGCAGGAACGGGAACC      //SEQ ID NO: 672
ACCACCACCGGA;
```

The oligo duplex is shown below:

```
    TGGTTCCGGTGGTGGTGGTTCCCGTTCCTGCATCGACACCATCCCGAAATCCCGTTGCAC    //SEQ ID NO: 673
1---------+---------+---------+---------+---------+---------+   60
    AGGCCACCACCACCAAGGGCAAGGACGTAGCTGTGGTAGGGCTTTAGGGCAACGTG        //SEQ ID NO: 675
    G  S  G  G  G  G  S  R  S  C  I  D  T  I  P  K  S  R  C  T  -  //SEQ ID NO: 674

CGCTTTCCAGTGCAAACACTCCATGAAATACCGTCTGTCCTTCTGCCGTAAAACCTGCGG
61---------+---------+---------+---------+---------+---------+   120
    GCGAAAGGTCACGTTTGTGAGGTACTTTATGGCAGACAGGAAGACGGCATTTTGGACGCC
    A  F  Q  C  K  H  S  M  K  Y  R  L  S  F  C  R  K  T  C  G  -

TACCTGC
121-------
    ATGGACGATTC
    T  C  -
```

The mix was heated to 80° C. and allowed to cool at 0.1 degree/sec to room temperature. To this was added 10 µl of 1× ligase buffer plus 400 units of T4 DNA ligase. The sample was incubated at 14 C for 20 min. Ligase was inactivated by heating at 65° C. for 10 minutes. Next, 10 units of restriction endonucleases BsmBI were added followed by incubation at 55 C for one hour to cleave any reformed parental vector molecules. Fifty ul of chemically competent E. coli cells were added and held at 2 C for 20 minutes followed by heat shock at 42 C for 5 second. The entire volume was spread onto Luria Agar plates supplemented with carbenicillin at 200 ug/ml and incubated overnight at 37 C. Colonies were tested for the loss of resistance to the replaceable antibiotic resistance marker. A standard PCR test can be used to confirm the expected size of Bacterial expression of the peptibody was as described in Example 3 and paste was stored frozen. Purification of bacterially expressed Fc-L10-ShK(1-35) is further described in Example 38 herein below.

Example 4

Fc-L-ShK[2-35] Bacterial Expression

Bacterial expression of Fc-L-ShK[2-35]. The methods to clone and express the peptibody in bacteria are described in Example 3. The vector used was pAMG21ampR-Fc-Pep and the oligos listed below were used to generate a duplex (see below) for cloning and expression in bacteria of Fc-L-ShK [2-35].

Oligos used to form duplex are shown below:

TGGTTCCGGTGGTGGTGGTTCCTGCATCGACACCATCCCGAAATCCCGTTGCACCGCTTTCCAGTGCAAACACTCCATGAAAT; //SEQ ID NO: 676

ACCGTCTGTCCTTCTGCCGTAAAACCTGCGGTACCTGC; //SEQ ID NO: 677

CTTAGCAGGTACCGCAGGTTTTACGGCAGAAGGACAGACGGTATTTCATGGAGTGTTTGCACTGGAAAGCGGTGCAACGGGA; //SEQ ID NO: 678

TTTCGGGATGGTGTCGATGCAGGAACCACCACCACCGGA; //SEQ ID NO: 679

The oligo duplex formed is shown below:
```
    TGGTTCCGGTGGTGGTGGTTCCTGCATCGACACCATCCCGAAATCCCGTTGCACCGCTTT        //SEQ ID NO: 680
  1---------+---------+---------+---------+---------+---------+   60
        AGGCCACCACCACCAAGGACGTAGCTGTGGTAGGGCTTTAGGGCAACGTGGCGAAA        //SEQ ID NO: 682
      G  S  G  G  G  G  S  C  I  D  T  I  P  K  S  R  C  T  A  F -    //SEQ ID NO: 681

CCAGTGCAAACACTCCATGAAATACCGTCTGTCCTTCTGCCGTAAAACCTGCGGTACCTG
 61---------+---------+---------+---------+---------+---------+  120
    GGTCACGTTTGTGAGGTACTTTATGGCAGACAGGAAGACGGCATTTTGGACGCCATGGAC
      Q  C  K  H  S  M  K  Y  R  L  S  F  C  R  K  T  C  G  T  C -

C
121-
    GATTC
```

Bacterial expression of the peptibody was as described in Example 3 and paste was stored frozen. Purification of bacterially expressed Fc-L10-ShK(2-35) is further described in Example 39 herein below.

Example 5

Fc-L-HmK Bacterial Expression

Bacterial expression of Fc-L-HmK. The methods to clone and express the peptibody in bacteria are described in Example 3. The vector used was pAMG21ampR-Fc-Pep and the oligos listed below were used to generate a duplex (see below) for cloning and expression in bacteria of Fc-L-HmK.

Oligos used to form duplex are shown below:

TGGTTCCGGTGGTGGTGGTTCCCGTACCTGCAAAGACCTGAT; //SEQ ID NO: 690

CCCGGTTTCCGAATGCACCGACATCCGTTGCCGTACCTCCATGAAATACCGTCTGAACCTGTGCCGTAAAACCTGCGGTTCCTGC; SEQ ID NO: 692

CTTAGCAGGAACCGCAGGTTTTACGGCACAGGTTCAGACGGT; //SEQ ID NO: 693

4142-94
ATTTCATGGAGGTACGGCAACGGATGTCGGTGCATTCGGAAACCGGGATCAGGTCTTTGCAGGTACGGGAACCACCACCACCGGA //SEQ ID NO: 694

Bacterial expression of the peptibody was as described in Example 3 and paste was stored frozen.

Example 6

Fc-L-KTX1 Bacterial Expression

Bacterial expression of Fc-L-KTX1. The methods to clone and express the peptibody in bacteria are described in Example 3. The vector used was pAMG21ampR-Fc-Pep and the oligos listed below were used to generate a duplex (see below) for cloning and expression in bacteria of Fc-L-KTX1.

The oligo duplex formed is shown below:
```
    TGGTTCCGGTGGTGGTGGTTCCCGTACCTGCAAAGACCTGATCCCGGTTTCCGAATGCAC    //SEQ ID NO: 695
  1---------+---------+---------+---------+---------+---------+   60
        AGGCCACCACCACCAAGGGCATGGACGTTTCTGGACTAGGGCCAAAGGCTTACGTG     //SEQ ID NO: 697
      G  S  G  G  G  G  S  R  T  C  K  D  L  I  P  V  S  E  C  T - //SEQ ID NO: 696

CGACATCCGTTGCCGTACCTCCATGAAATACCGTCTGAACCTGTGCCGTAAAACCTGCGG
 61---------+---------+---------+---------+---------+---------+  120
    GCTGTAGGCAACGGCATGGAGGTACTTTATGGCAGACTTGGACACGGCATTTTGGACGCC
      D  I  R  C  R  T  S  M  K  Y  R  L  N  L  C  R  K  T  C  G -

TTCCTGC
121-------
    AAGCACGATTC
      S  C -
```

Oligos used to form duplex are shown below

```
TGGTTCCGGTGGTGGTGGTTCCGGTGTTGAAATCAACGTTAAATGCT;                                              //SEQ ID NO: 698

CCGGTTCCCCGCAGTGCCTGAAACCGTGCAAAGACGCTGGTATGCGTTTCGGTAAATGCATGAACCGTAAATGCCACTGCAC           //SEQ ID NO: 699
CCCGAAA;

CTTATTTCGGGGTGCAGTGGCATTTACGGTTCATGCATTTACCGAAA;                                             //SEQ ID NO: 700

CGCATACCAGCGTCTTTGCACGGTTTCAGGCACTGCGGGGAACCGGAGCATTTAACGTTGATTTCAACACCGGAACCACCAC           //SEQ ID NO: 701
CACCGGA;
```

The oligo duplex formed is shown below:

```
    TGGTTCCGGTGGTGGTGGTTCCGGTGTTGAAATCAACGTTAAATGCTCCGGTTCCCCGCA        //SEQ ID NO: 702
  1---------+---------+---------+---------+---------+---------+   60
        AGGCCACCACCACCAAGGCCACAACTTTAGTTGCAATTTACGAGGCCAAGGGCGT         //SEQ ID NO: 704
      G  S  G  G  G  G  S  G  V  E  I  N  V  K  C  S  G  S  P  Q  -    //SEQ ID NO: 703

GTGCCTGAAACCGTGCAAAGACGCTGGTATGCGTTTCGGTAAATGCATGAACCGTAAATG
 61---------+---------+---------+---------+---------+---------+  120
    CACGGACTTTGGCACGTTTCTGCGACCATACGCAAAGCCATTTACGTACTTGGCATTTAC
      C  L  K  P  C  K  D  A  G  M  R  F  G  K  C  M  N  R  K  C  -

CCACTGCACCCCGAAA
121---------+------
    GGTGACGTGGGGCTTTATTC
      H  C  T  P  K   -
```

Bacterial expression of the peptibody was as described in Example 3 and paste was stored frozen.

Purification and refolding of Fc-L-KTX1 expressed in bacteria. Frozen, E. coli paste (28 g) was combined with 210 ml of room temperature 50 mM tris HCl, 5 mM EDTA, pH 8.0 and was brought to about 0.1 mg/ml hen egg white lysozyme. The suspended paste was passed through a chilled microfluidizer twice at 12,000 PSI. The cell lysate was then centrifuged at 22,000 g for 20 min at 4° C. The pellet was then resuspended in 200 ml 1% deoxycholic acid using a tissue grinder and then centrifuged at 22,000 g for 20 min at 4° C. The pellet was then resuspended in 200 ml water using a tissue grinder and then centrifuged at 22,000 g for 20 min at 4° C. The pellet (4.8 g) was then dissolved in 48 ml 8 M guanidine HCl, 50 mM tris HCl, pH 8.0. The dissolved pellet was then reduced by adding 30 µl 1 M dithiothreitol to 3 ml of the solution and incubating at 37° C. for 30 minutes. The reduced pellet solution was then centrifuged at 14,000 g for 5 min at room temperature, and then 2.5 ml of the supernatant was transferred to 250 ml of the refolding buffer (2 M urea, 50 mM tris, 160 mM arginine HCl, 5 mM EDTA, 1 mM cystamine HCl, 4 mM cysteine, pH 8.5) at 4° C. with vigorous stirring. The stirring rate was then slowed and the incubation was continued for 2 days at 4° C. The refolding solution was then filtered through a 0.22 µm cellulose acetate filter and stored at 4° C. for 3 days.

The stored refold was then diluted with 1 L of water and the pH was adjusted to 7.5 using 1 M $H_3PO_4$. The pH adjusted material was then loaded on to a 10 ml Amersham SP-HP HiTrap column at 10 ml/min in S-Buffer A (20 mM $NaH_2PO_4$, pH 7.3) at 7° C. The column was then washed with several column volumes of S-Buffer A, followed by elution with a linear gradient from 0% to 60% S-Buffer B (20 mM $NaH_2PO_4$, 1 M NaCl, pH 7.3) followed by a step to 100% S-Buffer B at 5 ml/min 7° C. Fractions were then analyzed using a Coomassie brilliant blue stained tris-glycine 4-20% SDS-PAGE, and the fractions containing the desired product were pooled based on these data (45 ml). The pool was then loaded on to a 1 ml Amersham rProtein A HiTrap column in PBS at 2 ml/min 7° C. Then column was then washed with several column volumes of PBS and eluted with 100 mM glycine pH 3.0. To the elution peak (2.5 ml), 62.5 µl 2 M tris base was added, and then the pH adjusted material was filtered though a Pall Life Sciences Acrodisc with a 0.22 µm, 25 mm Mustang E membrane at 2 ml/min room temperature.

A spectral scan was then conducted on 20 µl of the combined pool diluted in 700 µl PBS using a Hewlett Packard 8453 spectrophotometer (FIG. 28C). The concentration of the filtered material was determined to be 2.49 mg/ml using a calculated molecular mass of 30,504 g/mol and extinction coefficient of 35,410 $M^{-1}$ $cm^{-1}$. The purity of the filtered material was then assessed using a Coomassie brilliant blue stained tris-glycine 4-20% SDS-PAGE (FIG. 28A). The endotoxin level was then determined using a Charles River Laboratories Endosafe-PTS system (0.05-5 EU/ml sensitivity) using a 50-fold dilution of the sample in Charles Rivers Endotoxin Specific Buffer BG120 yielding a result of <1 EU/mg protein. The macromolecular state of the product was then determined using size exclusion chromatography on 45 µg of the product injected on to a Phenomenex BioSep SEC 3000 column (7.8×300 mm) in 50 mM $NaH_2PO_4$, 250 mM NaCl, pH 6.9 at 1 ml/min observing the absorbance at 280 nm (FIG. 28B). The product was then subject to mass spectral analysis by diluting 1 µl of the sample into 10 µl of sinapinic acid (10 mg per ml in 0.05% trifluroacetic acid, 50% acetonitrile). The resultant solution (1 µl) was spotted onto a MALDI sample plate. The sample was allowed to dry before being analyzed using a Voyager DE-RP time-of-flight mass spectrometer equipped with a nitrogen laser (337 nm, 3 ns pulse). The positive ion/linear mode was used, with an accelerating voltage of 25 kV. Each spectrum was produced by accumulating data from ~200 laser shots. External mass calibration was accomplished using purified proteins of known molecular masses (FIG. 28D) and these studies confirmed the integrity of the purified peptibody, within experimental error. The product was then stored at −80° C.

Purified Fc-L-KTX1 blocked the human Kv1.3 current in a dose-dependent fashion (FIG. 32A and FIG. 32B) by electrophysiology (method was as described in Example 36).

Example 7

Fc-L-HsTx1 Bacterial Expression

Bacterial expression of Fc-L-HsT1. The methods to clone and express the peptibody in bacteria are described in Example 3. The vector used was pAMG21ampR-Fc-Pep and the oligos listed below were used to generate a duplex (see below) for cloning and expression in bacteria of Fc-L-HsTx1.

Oligos used to form duplex are shown below:

TGGTTCCGGTGGTGGTGGTTCCGCTTCCTGCCGTACCCCGAAAGAC;  //SEQ ID NO: 705

TGCGCTGACCCGTGCCGTAAAGAAACCCGTTGCCCGTACGGTAAATGCATGAACCGTAAATGCAAATGCAACCGTTGC;  //SEQ ID NO: 706

CTTAGCAACGGTTGCATTTGCATTTACGGTTCATGCATTTACCGTACG;  //SEQ ID NO: 707

GGCAACCGGTTTCTTTACGGCACGGGTCAGCGCAGTCTTTCGGGGTACGGCAGGAAGCGGAACCACCACCACCGGA;  //SEQ ID NO: 708

The duplex formed by the oligos above is shown below:

```
    TGGTTCCGGTGGTGGTGGTTCCGCTTCCTGCCGTACCCCGAAAGACTGCGCTGACCCGTG      SEQ ID NO: 709
1---------+---------+---------+---------+---------+---------+   60
        AGGCCACCACCACCAAGGCGAAGGACGGCATGGGGCTTTCTGACGCGACTGGGCAC      SEQ ID NO: 711
     G   S   G   G   G   S   A   S   C   R   T   P   K   D   C   A   D   P   C   -   SEQ ID NO: 710

CCGTAAAGAAACCGGTTGCCCGTACGGTAAATGCATGAACCGTAAATGCAAATGCAACCG
61---------+---------+---------+---------+---------+---------+  120
    GGCATTTCTTTGGCCAACGGGCATGCCATTTACGTACTTGGCATTTACGTTTACGTTGGC
     R   K   S   T   G   C   P   Y   G   K   C   M   N   R   K   C   K   C   N   R   -

TTGC
121----  124
     AACGATTC
       C   -
```

Bacterial expression of the peptibody was as described in Example 3 and paste was stored frozen.

Example 8

Fc-L-MgTx Bacterial Expression

Bacterial expression of Fc-L-MgTx. The methods to clone and express the peptibody in bacteria are described in Example 3. The vector used was pAMG21ampR-Fc-Pep and the oligos listed below were used to generate a duplex (see below) for cloning and expression in bacteria of Fc-L-MgTx.

Oligos used to form duplex are shown below:

TGGTTCCGGTGGTGGTGGTTCCACCATCATCAACGTTAAATGCACCTC;  //SEQ ID NO: 712

CCCGAAACAGTGCCTGCCGCCGTGCAAAGCTCAGTTCGGTCAGTCCGCTGGTGCTAAATGCATGAACGGTAAATGCAAATGCTACCCGCAC;  //SEQ ID NO: 713

CTTAGTGCGGGTAGCATTTGCATTTACCGTTCATGCATTTAGCACCAG;  //SEQ ID NO: 714

CGGACTGACCGAACTGAGCTTTGCACGGCGGCAGGCACTGTTTCGGGGAGGTGCATTTAACGTTGATGATGGTGGAACCACCACCACCGGA;  //SEQ ID NO: 715

The oligos above were used to form the duplex shown below:

```
    TGGTTCCGGTGGTGGTGGTTCCACCATCATCAACGTTAAATGCACCTCCCCGAAACAGTG     SEQ ID NO: 716
1---------+---------+---------+---------+---------+---------+   60
    AGGCCACCACCACCAAGGTGGTAGTAGTTGCAATTTACGTGGAGGGGCTTTGTCAC         SEQ ID NO: 718
     G  S  G  G  G  G  S  T  I  I  N  V  K  C  T  S  P  K  Q  C  -  SEQ ID NO: 717

CCTGCCGCCGTGCAAAGCTCAGTTCGGTCAGTCCGCTGGTGCTAAATGCATGAACGGTAA
61---------+---------+---------+---------+---------+---------+  120
    GGACGGCGGCACGTTTCGAGTCAAGCCAGTCAGGCGACCACGATTTACGTACTTGCCATT
     L  P  P  C  K  A  Q  F  G  Q  S  A  G  A  K  C  M  N  G  K  -

ATGCAAATGCTACCCGCAC
121---------+---------
     TACGTTTACGATGGGCGTGATTC
      C  K  C  Y  P  H  -
```

Bacterial expression of the peptibody was as described in Example 3 and paste was stored frozen.

Example 9

Fc-L-AgTx2 Bacterial Expression

Bacterial expression of Fc-L-AgTx2. The methods to clone and express the peptibody in bacteria are described in Example 3. The vector used was pAMG21ampR-Fc-Pep and the oligos listed below were used to generate a duplex (see below) for cloning and expression in bacteria of Fc-L-AgTx2.

Oligos used to form duplex are shown below:

TGGTTCCGGTGGTGGTGGTTCCGGTGTTCCGATCAACGTTTCCTGCACCGGT;  //SEQ ID NO: 719

TCCCCGCAGTGCATCAAACCGTGCAAAGACGCTGGTATGCGTTTCGGTAAATGCATGAACCGTAAATGCCACT //SEQ ID NO: 720
GCACCCCGAAA;

CTTATTTCGGGGTGCAGTGGCATTTACGGTTCATGCATTTACCGAAACGCATA;  //SEQ ID NO: 721

CCAGCGTCTTTGCACGGTTTGATGCACTGCGGGGAACCGGTGCAGGAAACGTTGATCGGAACACCGGAACCAC //SEQ ID NO: 722
CACCACCGGA;

The oligos listed above were used to form the duplex shown below:

```
    TGGTTCCGGTGGTGGTGGTTCCGGTGTTCCGATCAACGTTTCCTGCACCGGTTCCCCGCA     SEQ ID NO: 723
1---------+---------+---------+---------+---------+---------+   60
    AGGCCACCACCACCAAGGCCACAAGGCTAGTTGCAAAGGACGTGGCCAAGGGGCGT         SEQ ID NO: 725
     G  S  G  G  G  G  S  G  V  P  I  N  V  S  C  T  G  S  P  Q  -  SEQ ID NO: 724
    GTGCATCAAACCGTGCAAAGACGCTGGTATGCGTTTCGGTAAATGCATGAACCGTAAATG
61---------+---------+---------+---------+---------+---------+  120
    CACGTAGTTTGGCACGTTTCTGCGACCATACGCAAAGCCATTTACGTACTTGGCATTTAC
     C  I  K  P  C  K  D  A  G  M  R  F  G  K  C  M  N  R  K  C  -
     CCACTGCACCCCGAAA_
121---------+------
     GGTGACGTGGGGCTTTATTC
      H  C  T  P  K  -
```

Bacterial expression of the peptibody was as described in Example 3 and paste was stored frozen.

Refolding and purification of Fc-L-AgTx2 expressed in bacteria. Frozen, *E. coli* paste (15 g) was combined with 120 ml of room temperature 50 mM tris HCl, 5 mM EDTA, pH 8.0 and was brought to about 0.1 mg/ml hen egg white lysozyme. The suspended paste was passed through a chilled microfluidizer twice at 12,000 PSI. The cell lysate was then centrifuged at 22,000 g for 20 min at 4° C. The pellet was then resuspended in 200 ml 1% deoxycholic acid using a tissue grinder and then centrifuged at 22,000 g for 20 min at 4° C. The pellet was then resuspended in 200 ml water using a tissue grinder and then centrifuged at 22,000 g for 20 min at 4° C. The pellet (4.6 g) was then dissolved in 46 ml 8 M guanidine HCl, 50 mM tris HCl, pH 8.0. The dissolved pellet was then reduced by adding 30 μl 1 M dithiothreitol to 3 ml of the solution and incubating at 37° C. for 30 minutes. The reduced pellet solution was then centrifuged at 14,000 g for 5 min at room temperature, and then 2.5 ml of the supernatant was transferred to 250 ml of the refolding buffer (2 M urea, 50 mM tris, 160 mM arginine HCl, 5 mM EDTA, 1 mM cystamine HCl, 4 mM cysteine, pH 9.5) at 4° C. with vigorous stirring. The stirring rate was then slowed and the incubation was continued for 2 days at 4° C. The refolding solution was then filtered through a 0.22 μm cellulose acetate filter and stored at −70° C.

The stored refold was defrosted and then diluted with 1 L of water and the pH was adjusted to 7.5 using 1 M H$_3$PO$_4$. The pH adjusted material was then filtered through a 0.22 μm cellulose acetate filter and loaded on to a 10 ml Amersham SP-HP HiTrap column at 10 ml/min in S-Buffer A (20 mM NaH$_2$PO$_4$, pH 7.3) at 7° C. The column was then washed with several column volumes of S-Buffer A, followed by elution with a linear gradient from 0% to 60% S-Buffer B (20 mM NaH$_2$PO$_4$, 1 M NaCl, pH 7.3) followed by a step to 100% S-Buffer B at 5 ml/min 7° C. Fractions were then analyzed using a Coomassie brilliant blue stained tris-glycine 4-20% SDS-PAGE, and the fractions containing the desired product were pooled based on these data (15 ml). The pool was then loaded on to a 1 ml Amersham rProtein A HiTrap column in PBS at 2 ml/min 7° C. Then column was then washed with several column volumes of 20 mM NaH$_2$PO$_4$ pH 6.5, 1 M NaCl and eluted with 100 mM glycine pH 3.0. To the elution peak (1.5 ml), 70 µl 1 M tris HCl pH 8.5 was added, and then the pH-adjusted material was filtered though a 0.22 µm cellulose acetate filter.

A spectral scan was then conducted on 20 µl of the combined pool diluted in 700 µl PBS using a Hewlett Packard 8453 spectrophotometer (FIG. 29C). The concentration of the filtered material was determined to be 1.65 mg/ml using a calculated molecular mass of 30,446 g/mol and extinction coefficient of 35,410 M$^{-1}$ cm$^{-1}$. The purity of the filtered material was then assessed using a Coomassie brilliant blue stained tris-glycine 4-20% SDS-PAGE (FIG. 29A). The endotoxin level was then determined using a Charles River Laboratories Endosafe-PTS system (0.05-5 EU/ml sensitivity) using a 33-fold dilution of the sample in Charles Rivers Endotoxin Specific Buffer BG120 yielding a result of <4 EU/mg protein. The macromolecular state of the product was then determined using size exclusion chromatography on 20 µg of the product injected on to a Phenomenex BioSep SEC 3000 column (7.8×300 mm) in 50 mM NaH$_2$PO$_4$, 250 mM NaCl, pH 6.9 at 1 ml/min observing the absorbance at 280 nm (FIG. 29D). The product was then subject to mass spectral analysis by diluting 1 µl of the sample into 10 µl of sinapinic acid (10 mg per ml in 0.05% trifluroacetic acid, 50% acetonitrile). The resultant solution (1 µl) was spotted onto a MALDI sample plate. The sample was allowed to dry before being analyzed using a Voyager DE-RP time-of-flight mass spectrometer equipped with a nitrogen laser (337 nm, 3 ns pulse). The positive ion/linear mode was used, with an accelerating voltage of 25 kV. Each spectrum was produced by accumulating data from ~200 laser shots. External mass calibration was accomplished using purified proteins of known molecular masses (FIG. 29E) and these studies confirmed the integrity of the purified peptibody, within experimental error. The product was then stored at −80° C.

Example 10

Fc-L-OSK1 Bacterial Expression

Bacterial expression of Fc-L-OSK1. The methods used to clone and express the peptibody in bacteria were as described in Example 3. The vector used was pAMG21ampR-Fc-Pep and the oligos listed below were used to generate a duplex (see below) for cloning and expression in bacteria of Fc-L-OSK1.

Oligos used to form duplex are shown below:

```
TGGTTCCGGTGGTGGTGGTTCCGGTGTTATCATCAACGTTAAATGCAAAATCTCCCGTCAGTGCCTGGAACCG    //SEQ ID NO: 726
TGCAAAAAAG;

CTGGTATGCGTTTCGGTAAATGCATGAACGGTAAATGCCACTGCACCCCGAAA;                       //SEQ ID NO: 727

CTTATTTCGGGGTGCAGTGGCATTTACCGTTCATGCATTTACCGAAACGCATACCAGCTTTTTTGCACGGTTC    //SEQ ID NO: 728
CAGGCACTGA;

CGGGAGATTTTGCATTTAACGTTGATGATAACACCGGAACCACCACCACCGGA;                       //SEQ ID NO: 729
```

The oligos shown above were used to form the duplex below:

```
    TGGTTCCGGTGGTGGTGGTTCCGGTGTTATCATCAACGTTAAATGCAAAATCTCCCGTCA        SEQ ID NO: 730
1---------+---------+---------+---------+---------+---------+    60
        AGGCCACCACCACCAAGGCCACAATAGTAGTTGCAATTTACGTTTTAGAGGGCAGT        SEQ ID NO: 732
     G  S  G  G  G  G  S  G  V  I  I  N  V  K  C  K  I  S  R  Q   -    SEQ ID NO: 731

GTGCCTGGAACCGTGCAAAAAAGCTGGTATGCGTTTCGGTAAATGCATGAACGGTAAATG
61--------+---------+---------+---------+---------+---------+    120
    CACGGACCTTGGCACGTTTTTTCGACCATACGCAAAGCCATTTACGTACTTGCCATTTAC
     C  L  E  P  C  K  K  A  G  M  R  F  G  K  C  N  N  G  K  C   -

CCACTGCACCCCGAAA
121---------+------
    GGTGACGTGGGGCTTTATTC
     H  C  T  P  K   -
```

Bacterial expression of the peptibody was as described in Example 3 and paste was stored frozen for later use. Purification of Fc-L10-OSK1 from *E. coli* paste is described in Example 40 herein below.

Example 11

Fc-L-OSK1(E16K,K20D) Bacterial Expression

Bacterial expression of Fc-L-OSK1(E16K,K20D). The methods to clone and express the peptibody in bacteria are described in Example 3. The vector used was pAMG21ampR-Fc-Pep and the oligos listed below were used to generate a duplex (see below) for cloning and expression in bacteria of Fc-L-OSK1(E16K,K20D).

Oligos used to form duplex are shown below:

```
TGGTTCCGGTGGTGGTGGTTCCGGTGTTATCATCAACGTTAAATGCAAAATCTCCCGTCAGTGCCTGAAACCG   //SEQ ID NO: 733
TGCAAAGACG;

CTGGTATGCGTTTCGGTAAATGCATGAACGGTAAATGCCACTGCACCCCGAAA;                      //SEQ ID NO: 734

CTTATTTCGGGGTGCAGTGGCATTTACCGTTCATGCATTTACCGAAACGCATACCAGCGTCTTTGCACGGTTT   //SEQ ID NO: 735
CAGGCACTGA;

CGGGAGATTTTGCATTTAACGTTGATGATAACACCGGAACCACCACCACCGGA;                      //SEQ ID NO: 736
```

The oligos shown above were used to form the duplex below:

```
    TGGTTCCGGTGGTGGTGGTTCCGGTGTTATCATCAACGTTAAATGCAAAATCTCCCGTCA      SEQ ID NO: 737
  1---------+---------+---------+---------+---------+---------+  60
    AGGCCACCACCACCAAGGCCACAATAGTAGTTGCAATTTACGTTTTAGAGGGCAGT        SEQ ID NO: 739
     G  S  G  G  G  G  S  G  V  I  I  N  V  K  C  K  I  S  R  Q  -  SEQ ID NO: 738

GTGCCTGAAACCGTGCAAAGACGCTGGTATGCGTTTCGGTAAATGCATGAACGGTAAATG
 61---------+---------+---------+---------+---------+---------+  120
    CACGGACTTTGGCACGTTTCTGCGACCATACGCAAAGCCATTTACGTACTTGCCATTTAC
     C  L  K  P  C  K  D  A  G  M  R  F  G  K  C  M  N  G  K  C  -

CCACTGCACCCCGAAA
121---------+------
    GGTGACGTGGGGCTTTATTC
     H  C  T  P  K  -
```

Bacterial expression of the peptibody was as described in Example 3 and paste was stored frozen for later use.

Example 12

Fc-L-Anuroctoxin Bacterial Expression

Bacterial expression of Fc-L-Anuroctoxin. The methods to clone and express the peptibody in bacteria are described in Example 3. The vector used was pAMG21ampR-Fc-Pep and the oligos listed below were used to generate a duplex (see below) for cloning and expression in bacteria of Fc-L-Anuroctoxin.

Oligos used to form duplex are shown below:

```
TGGTTCCGGTGGTGGTGGTTCCAAAGAATGCACCGGTCCGCAGCACTGCACCAACTTCTGCCGTAAAAACAAA   //SEQ ID NO: 740
TGCACCCACG;

GTAAATGCATGAACCGTAAATGCAAATGCTTCAACTGCAAA;                                  //SEQ ID NO: 741

CTTATTTGCAGTTGAAGCATTTGCATTTACGGTTCATGCATTTACCGTGGGTGCATTTGTTTTTACGGCAGAA   //SEQ ID NO: 742
GTTGGTGCAG;

TGCTGCGGACCGGTGCATTCTTTGGAACCACCACCACCGGA;                                  //SEQ ID NO: 743
```

The oligos shown above were used to form the duplex below:

```
    TGGTTCCGGTGGTGGTGGTTCCAAAGAATGCACCGGTCCGCAGCACTGCACCAACTTCTG        SEQ ID NO: 744
  1---------+---------+---------+---------+---------+---------+    60
        AGGCCACCACCACCAAGGTTTCTTACGTGGCCAGGCGTCGTGACGTGGTTGAAGAC        SEQ ID NO: 746
      G  S  G  G  G  G  S  K  E  C  T  G  P  Q  H  C  T  N  F  C -    SEQ ID NO: 745

CCGTAAAAACAAATGCACCCACGGTAAATGCATGAACCGTAAATGCAAATGCTTCAACTG
 61---------+---------+---------+---------+---------+---------+    120
    GGCATTTTTGTTTACGTGGGTGCCATTTACGTACTTGGCATTTACGTTTACGAAGTTGAC
      R  K  N  K  C  T  H  G  K  C  M  N  R  K  C  K  C  F  N  C -

CAAA
121----
    GTTTATTC
      K  -
```

Bacterial expression of the peptibody was as described in Example 3 and paste was stored frozen.

Example 13

Fc-L-Noxiustoxin Bacterial Expression

Bacterial expression of Fc-L-Noxiustoxin or Fc-L-NTX. The methods to clone and express the peptibody in bacteria are described in Example 3. The vector used was pAMG21ampR-Fc-Pep and the oligos listed below were used to generate a duplex (see below) for cloning and expression in bacteria of Fc-L-NTX.

Oligos used to form duplex are shown below:

```
TGGTTCCGGTGGTGGTGGTTCCACCATCATCAACGTTAAATGCACCTCCCCGAAACAGTGCTCCAAACCGTGC   //SEQ ID NO: 747
AAAGAACTGT;

ACGGTTCCTCCGCTGGTGCTAATGCATGAACGGTAAATGCAAATGCTACAACAAC;                    //SEQ ID NO: 748

CTTAGTTGTTGTAGCATTTGCATTTACCGTTCATGCATTTAGCACCAGCGGAGGAACCGTACAGTTCTTTGCA   //SEQ ID NO: 749
CGGTTTGGAG;

CACTGTTTCGGGGAGGTGCATTTAACGTTGATGATGGTGGAACCACCACCACCGGA;                   //SEQ ID NO: 750
```

The oligos shown above were used to form the duplex below:

```
   TGGTTCCGGTGGTGGTGGTTCCACCATCATCAACGTTAAATGCACCTCCCCGAAACAGTG      SEQ ID NO: 751
 1---------+---------+---------+---------+---------+---------+     60
       AGGCCACCACCACCAAGGTGGTAGTAGTTGCAATTTACGTGGAGGGGCTTTGTCAC      SEQ ID NO: 753
    G  S  G  G  G  G  S  T  I  I  N  V  K  C  T  S  P  K  Q  C  -    SEQ ID NO: 752

CTCCAAACCGTGCAAAGAACTGTACGGTTCCTCCGCTGGTGCTAAATGCATGAACGGTAA
61---------+---------+---------+---------+---------+---------+    120
   GAGGTTTGGCACGTTTCTTGACATGCCAAGGAGGCGACCACGATTTACGTACTTGCCATT
    S  K  P  C  K  E  L  Y  G  S  S  A  G  A  K  C  M  N  G  K  -

ATGCAAATGCTACAACAAC
121---------+---------
   TACGTTTACGATGTTGTTGATTC
    C  K  C  Y  N  N   -
```

Bacterial expression of the peptibody was as described in Example 3 and paste was stored frozen.

Example 14

Fc-L-Pi2 Bacterial Expression

Bacterial expression of Fc-L-Pi2. The methods to clone and express the peptibody in bacteria are described in Example 3. The vector used was pAMG21ampR-Fc-Pep and the oligos listed below were used to generate a duplex (see below) for cloning and expression in bacteria of Fc-L-Pi2.

Oligos used to form duplex are shown below:

TGGTTCCGGTGGTGGTGGTTCCACCATCTCCTGCACCAACCCG;                                                    //SEQ ID NO: 754

AAACAGTGCTACCCGCACTGCAAAAAAGAAACCGGTTACCCGAACGCTAAATGCATGAACCGTAAATGCAAAT   //SEQ ID NO: 755
GCTTCGGTCGT;

CTTAACGACCGAAGCATTTGCATTTACGGTTCATGCATTTAGCG;                                                  //SEQ ID NO: 756

TTCGGGTAACCGGTTTCTTTTTTGCAGTGCGGGTAGCACTGTTTCGGGTTGGTGCAGGAGATGGTGGAACCAC   //SEQ ID NO: 757
CACCACCGGA;

The oligos above were used to form the duplex below:

```
    TGGTTCCGGTGGTGGTGGTTCCACCATCTCCTGCACCAACCCGAAACAGTGCTACCCGCA        SEQ ID NO: 758
1---------+---------+---------+---------+---------+---------+    60
        AGGCCACCACCACCAAGGTGGTAGAGGACGTGGTTGGGCTTTGTCACGATGGGCGT        SEQ ID NO: 760
     G   S   G   G   G   S   T   I   S   C   T   N   P   K   Q   C   Y   P   H  -   SEQ ID NO: 759

CTGCAAAAAGAAACCGGTTACCCGAACGCTAAATGCATGAACCGTAAATGCAAATGCTT
61---------+---------+---------+---------+---------+---------+   120
    GACGTTTTTCTTTGGCCAATGGGCTTGCGATTTACGTACTTGGCATTTACGTTTACGAA
     C   K   K   E   T   G   Y   P   N   A   K   C   M   N   R   K   C   K   C   F  -

CGGTCGT
121-------
    GCCAGCAATTC
     G   R  -
```

Bacterial expression of the peptibody was as described in Example 3 and paste was stored frozen.

Example 15

ShK[1-35]-L-Fc Bacterial Expression

Bacterial expression of ShK[1-35]-L-Fc. The methods to clone and express the peptibody in bacteria are described in Example 3. The vector used was pAMG21ampR-Pep-Fc and the oligos listed below were used to generate a duplex (see below) for cloning and expression in bacteria of ShK[1-35]-L-Fc.

Oligos used to form duplex are shown below:

TATGCGTTCTTGTATTGATACTATTCCAAAATCTCGTTGTACTGCTTTTCAATGTAAACATTCTATGAAATAT   //SEQ ID NO: 761
CGTCTTTCTT;

TTTGTCGTAAAACTTGTGGTACTTGTTCTGGTGGTGGTGGTTCT;                                                    //SEQ ID NO: 762

CACCAGAACCACCACCACCAGAACAAGTACCACAAGTTTTACGACAAAAAGAAAGACGATATTTCATAGAATG   //SEQ ID NO: 763
TTTACATTGA;

AAAGCAGTACAACGAGATTTTGGAATAGTATCAATACAAGAACG;                                                  //SEQ ID NO: 764

The oligos shown above were used to form the duplex shown below:

```
    TATGCGTTCTTGTATTGATACTATTCCAAAATCTCGTTGTACTGCTTTTCAATGTAAACA        SEQ ID NO: 765
1---------+---------+---------+---------+---------+---------+    60
        GCAAGAACATAACTATGATAAGGTTTTAGAGCAACATGACGAAAAGTTACATTTGT        SEQ ID NO: 767
     M   R   S   C   I   D   T   I   P   K   S   R   C   T   A   F   Q   C   K   H  -   SEQ ID NO: 766

TTCTATGAAATATCGTCTTTCTTTTTGTCGTAAAACTTGTGGTACTTGTTCTGGTGGTGG
61---------+---------+---------+---------+---------+---------+   120
    AAGATACTTTATAGCAGAAAGAAAAACAGCATTTTGAACACCATGAACAAGACCACCACC
     S   M   K   Y   R   L   S   F   C   R   K   T   C   G   T   C   S   G   G   G  -
```

```
     TGGTTCT
121 -------                                                              127
     ACCAAGACCAC
       G  S   -
```

Bacterial expression of the peptibody was as described in Example 3 and paste was stored frozen. Purification of met-ShK[1-35]-Fc was as described in Example 51 herein below.

Example 16

ShK[2-35]-L-Fc Bacterial Expression

Bacterial expression of ShK[2-35]-L-Fc. The methods to clone and express the peptibody in bacteria are described in Example 3. The vector used was pAMG21ampR-Pep-Fc and the oligos listed below were used to generate a duplex (see below) for cloning and expression in bacteria of ShK[2-35]-L-Fc.

Oligos used to form duplex are shown below:

```
TATGTCTTGTATTGATACTATTCCAAAATCTCGTTGTACTGCTTTTCAATGTAAACATTCTATGAAATATCGT   //SEQ ID NO: 768
CTTTCTT;

TTTGTCGTAAAACTTGTGGTACTTGTTCTGGTGGTGGTTCT;                                  //SEQ ID NO: 769

CACCAGAACCACCACCACCAGAACAAGTACCACAAGTTTTACGACAAAAAGAAAGACGATATTTCATAGAATG  //SEQ ID NO: 770
TTTACATTGA;

AAAGCAGTACAACGAGATTTTGGAATAGTATCAATACAAGA;                                  SEQ ID NO: 771
```

The oligos above were used to form the duplex shown below:

```
    TATGTCTTGTATTGATACTATTCCAAAATCTCGTTGTACTGCTTTTCAATGTAAACATTC        SEQ ID NO: 772
1 ---------+---------+---------+---------+---------+---------+    60
        AGAACATAACTATGATAAGGTTTTAGAGCAACATGACGAAAAGTTACATTTGTAAG        SEQ ID NO: 774
      M  S  C  I  D  T  I  P  K  S  R  C  T  A  F  Q  C  K  H  S  -    SEQ ID NO: 773

TATGAAATATCGTCTTTCTTTTTGTCGTAAAACTTGTGGTACTTGTTCTGGTGGTGGTGG
61 ---------+---------+---------+---------+---------+---------+    120
     ATACTTTATAGCAGAAAGAAAAACAGCATTTTGAACACCATGAACAAGACCACCACCACC
      M  K  Y  R  L  S  F  C  R  K  T  C  G  T  C  S  G  G  G  G  -

TTCT
121 ----
     AAGACCAC
       S   -
```

Bacterial expression of the peptibody was as described in Example 3 and paste was stored frozen. Purification of the ShK[2-35]-Fc was as described in Example 50 herein below.

Example 17

Fc-L-ChTx Bacterial Expression

Bacterial expression of Fc-L-ChTx. The methods to clone and express the peptibody in bacteria are described in Example 3. The vector used was pAMG21ampR-Fc-Pep and the oligos listed below were used to generate a duplex (see below) for cloning and expression in bacteria of Fc-L-ChTx.

Oligos used to form duplex are shown below:

```
TGGTTCCGGTGGTGGTGGTTCCCAGTTCACCAACGTT;                                                //SEQ ID NO: 775

TCCTGCACCACCTCCAAAGAATGCTGGTCCGTTTGCCAGCGTCTGCACAACACCTCCCGTGGTAAATGCATGA //SEQ ID NO: 776
```

```
ACAAAAAATGCCGTTGCTACTCC;
CTTAGGAGTAGCAACGGCATTTTTTGTTCATGCATTTA;                                        //SEQ ID NO: 777

CCACGGGAGGTGTTGTGCAGACGCTGGCAAACGGACCAGCATTCTTTGGAGGTGGTGCAGGAAACGTTGGTGA     //SEQ ID NO: 778
ACTGGGAACCACCACCACCGGA;
```

The oligos shown above were used to form the duplex below:

```
    TGGTTCCGGTGGTGGTGGTTCCCAGTTCACCAACGTTTCCTGCACCACCTCCAAAGAATG         SEQ ID NO: 779
  1---------+---------+---------+---------+---------+---------+      60
        AGGCCACCACCACCAAGGGTCAAGTGGTTGCAAAGGACGTGGTGGAGGTTTCTTAC          SEQ ID NO: 781
      G  S  G  G  G  G  S  Q  F  T  N  V  S  C  T  T  S  K  E  C  -     SEQ ID NO: 780

CTGGTCCGTTTGCCAGCGTCTGCACAACACCTCCCGTGGTAAATGCATGAACAAAAAATG
 61---------+---------+---------+---------+---------+---------+       120
    GACCAGGCAAACGGTCGCAGACGTGTTGTGGAGGGCACCATTTACGTACTTGTTTTTTAC
      W  S  V  C  Q  R  L  H  N  T  S  R  G  K  C  M  N  K  K  C  -

CCGTTGCTACTCC
121---------+---
    GGCAACGATGAGGATTC
      R  C  Y  S  -
```

Bacterial expression of the peptibody was as described in Example 3 and paste was stored frozen.

Example 18

Fc-L-MTX Bacterial Expression

Bacterial expression of Fc-L-MTX. The methods to clone and express the peptibody in bacteria are described in Example 3. The vector used was pAMG21ampR-Fc-Pep and the oligos listed below were used to generate a duplex (see below) for cloning and expression in bacteria of Fc-L-MTX.

Oligos used to form duplex are shown below:

```
TGGTTCCGGTGGTGGTGGTTCCGTTTCCTGCACCGGT;                                         //SEQ ID NO: 782

TCCAAAGACTGCTACGCTCCGTGCCGTAAACAGACCGGTTGCCCGAACGCTAAATGCATCAACAAATCCTGCA     //SEQ ID NO: 783
AATGCTACGGTTGC;

CTTAGCAACCGTAGCATTTGCAGGATTTGTTGATGCAT;                                        //SEQ ID NO: 784

TTAGCGTTCGGGCAACCGGTCTGTTTACGGCACGGAGCGTAGCAGTCTTTGGAACCGGTGCAGGAAACGGAAC     //SEQ ID NO: 785
CACCACCACCGGA;
```

Bacterial expression of the peptibody was as described in Example 3 and paste was stored frozen.

Example 19

Fc-L-ChTx(K32E) Bacterial Expression

Bacterial expression of Fc-L-ChTx(K32E). The methods to clone and express the peptibody in bacteria are described in Example 3. The vector used was pAMG21ampR-Fc-Pep and the oligos listed below were used to generate a duplex (see below) for cloning and expression in bacteria of Fc-L-ChTx(K32E).

The oligos above were used to form the duplex shown below:

```
    TGGTTCCGGTGGTGGTGGTTCCGTTTCCTGCACCGGTTCCAAAGACTGCTACGCTCCGTG         SEQ ID NO: 786
  1---------+---------+---------+---------+---------+---------+      60
        AGGCCACCACCACCAAGGCAAAGGACGTGGCCAAGGTTTCTGACGATGCGAGGCAC          SEQ ID NO: 788
      G  S  G  G  G  G  S  V  S  C  T  G  S  K  D  C  Y  A  P  C  -     SEQ ID NO: 787

CCGTAAACAGACCGGTTGCCCGAACGCTAAATGCATCAACAAATCCTGCAAATGCTACGG
 61---------+---------+---------+---------+---------+---------+       120
    GGCATTTGTCTGGCCAACGGGCTTGCGATTTACGTAGTTGTTTAGGACGTTTACGATGCC
      R  K  Q  T  G  C  P  N  A  K  C  I  N  K  S  C  K  C  Y  G  -

TTGC
121----
    AACGATTC
      C  -
```

Oligos used to form duplex are shown below:

```
TGGTTCCGGTGGTGGTGGTTCCCAGTTCACCAACGTTTCCTG;                              //SEQ ID NO: 789

CACCACCTCCAAAGAATGCTGGTCCGTTTGCCAGCGTCTGCACAACACCTCCCGTGGTAAATGCATGAACAAA //SEQ ID NO: 790
GAATGCCGTTGCTACTCC;

CTTAGGAGTAGCAACGGCATTCTTTGTTCATGCATTTACCACG;                             //SEQ ID NO: 791

GGAGGTGTTGTGCAGACGCTGGCAAACGGACCAGCATTCTTTGGAGGTGGTGCAGGAAACGTTGGTGAACTGG //SEQ ID NO: 792
GAACCACCACCACCGGA;
```

The oligos shown above were used to form the duplex below:

```
     TGGTTCCGGTGGTGGTGGTTCCCAGTTCACCAACGTTTCCTGCACCACCTCCAAAGAATG    SEQ ID NO: 793
   1----------+---------+---------+---------+---------+---------+   60
         AGGCCACCACCACCAAGGGTCAAGTGGTTGCAAAGGACGTGGTGGAGGTTTCTTAC    SEQ ID NO: 795
      G  S  G  G  G  G  S  Q  F  T  N  V  S  C  T  T  S  K  E  C  - SEQ ID NO: 794

CTGGTCCGTTTGCCAGCGTCTGCACAACACCTCCCGTGGTAAATCCATGAACAAAGAATG
  61----------+---------+---------+---------+---------+---------+   120
     GACCAGGCAAACGGTCGCAGACGTGTTGTGGAGGGCACCATTTACGTACTTGTTTCTTAC
      W  S  V  C  Q  R  L  H  N  T  S  R  G  K  C  M  N  K  E  C  -

CCGTTGCTACTCC
 121----------+---
     GGCAACGATGAGGATTC
      R  C  Y  S  -
```

Bacterial expression of the peptibody was as described in Example 3 and paste was stored frozen.

Example 20

Fc-L-Apamin Bacterial Expression

Bacterial expression of Fc-L-Apamin. The methods to clone and express the peptibody in bacteria are described in Example 3. The vector used was pAMG21ampR-Fc-Pep and the oligos listed below were used to generate a duplex (see below) for cloning and expression in bacteria of Fc-L-Apamin.

Oligos used to form duplex are shown below:

Bacterial expression of the peptibody was as described in Example 3 and paste was stored frozen.

Example 21

Fc-L-Scyllatoxin Bacterial Expression

Bacterial expression of Fc-L-Scyllatoxin or Fc-L-ScyTx. The methods to clone and express the peptibody in bacteria are described in Example 3. The vector used was pAMG21ampR-Fc-Pep and the oligos listed below were used to generate a duplex (see below) for cloning and expression in bacteria of Fc-L-ScyTx.

```
TGGTTCCGGTGGTGGTGGTTCCTGCAACTGCAAAGCTCCGGAAACCGCTCTGTGCGCTCGTCGTTGC    //SEQ ID NO: 796
CAGCAGCACGGT;

CTTAACCGTGCTGCTGGCAACGACGAGCGCACAGAGCGGTTTCCGGAGCTTTGCAGTTGCAGGAACC    //SEQ ID NO: 797
ACCACCACCGGA;
```

The oligos above were used to form the duplex shown below:
```
       TGGTTCCGGTGGTGGTGGTTCCTGCAACTGCAAAGCTCCGGAAACCGCTCTGTGCGCTCG    SEQ ID NO: 798
    1----------+---------+---------+---------+---------+---------+     60
           AGGCCACCACCACCAACGACGTTGACGTTTCGAGGCCTTTGGCGACACACGCGAGC    SEQ ID NO: 800
         G  S  G  G  G  G  S  C  N  C  K  A  P  E  T  A  L  C  A  R  - SEQ ID NO: 799

TCGTTGCCAGCAGCACGGT
   61----------+---------
       AGCAACGGTCGTCGTGCCAATTC
         R  C  Q  Q  H  G  -
```

Oligos used to form duplex are shown below:

TGGTTCCGGTGGTGGTGGTTCCGCTTTCTGCAACCTGCG;  //SEQ ID NO: 801

TATGTGCCAGCTGTCCTGCCGTTCCCTGGGTCTGCTGGGTAAATGCATCGGTGACAAATGCGAATGCGTTAAA //SEQ ID NO: 802
CAC;

CTTAGTGTTTAACGCATTCGCATTTGTCACCGATGCATTT;  //SEQ ID NO: 803

ACCCAGCAGACCCAGGGAACGGCAGGACAGCTGGCACATACGCAGGTTGCAGAAAGCGGAACCACCACCACCG //SEQ ID NO: 804
GA;

The oligos above were used to form the duplex below:

```
    TGGTTCCGGTGGTGGTGGTTCCGCTTTCTGCAACCTGCGTATGTGCCAGCTGTCCTGCCG     SEQ ID NO: 805
1 ---------+---------+---------+---------+---------+---------+  60
    AGGCCACCACCACCAAGGCGAAAGACGTTGGACGCATACACGGTCGACAGGACGGC         SEQ ID NO: 807
    G  S  G  G  G  S  A  F  C  N  L  R  M  C  Q  L  S  C  R  -       SEQ ID NO: 806

TTCCCTGGGTCTGCTGGGTAAATGCATCGGTGACAAATGCGAATGCGTTAAACAC
61 ---------+---------+---------+---------+---------+-----
    AAGGGACCCAGACGACCCATTTACGTAGCCACTGTTTACGCTTACGCAATTTGTGATTC
    S  L  G  L  L  G  K  C  I  G  D  K  C  E  C  V  K  H  -
```

Bacterial expression of the peptibody was as described in Example 3 and paste was stored frozen.

Example 22

Fc-L-IbTx Bacterial Expression

Bacterial expression of Fc-L-IbTx. The methods to clone and express the peptibody in bacteria are described in Example 3. The vector used was pAMG21ampR-Fc-Pep and the oligos listed below were used to generate a duplex (see below) for cloning and expression in bacteria of Fc-L-IbTx.

Oligos used to form duplex are shown below:

TGGTTCCGGTGGTGGTGGTTCCCAGTTCACCGACGTTGACTGCTCCGT;  //SEQ ID NO: 808

TTCCAAAGAATGCTGGTCCGTTTGCAAAGACCTGTTCGGTGTTGACCGTGGTAAATGCATGGGTAAAAAATGC //SEQ ID NO: 809
CGTTGCTACCAG;

CTTACTGGTAGCAACGGCATTTTTTACCCATGCATTTACCACGGTCAA;  //SEQ ID NO: 810

CACCGAACAGGTCTTTGCAAACGGACCAGCATTCTTTGGAAACGGAGCAGTCAACGTCGGTGAACTGGGAACC //SEQ ID NO: 811
ACCACCACCGGA;

Bacterial expression of the peptibody was as described in Example 3 and paste was stored frozen.

Example 23

Fc-L-HaTx1 Bacterial Expression

Bacterial expression of Fc-L-HaTx1. The methods to clone and express the peptibody in bacteria are described in Example 3. The vector used was pAMG21ampR-Fc-Pep and the oligos listed below were used to generate a duplex (see below) for cloning and expression in bacteria of Fc-L-HaTx1.

The oligos above were used to form the duplex below:

```
    TGGTTCCGGTGGTGGTGGTTCCCAGTTCACCGACGTTGACTGCTCCGTTTCCAAAGAATG     SEQ ID NO: 812
1 ---------+---------+---------+---------+---------+---------+  60
    AGGCCACCACCACCAAGGGTCAAGTGGCTGCAACTGACGAGGCAAAGGTTTCTTAC         SEQ ID NO: 814
    G  S  G  G  G  S  Q  F  T  D  V  D  C  S  V  S  K  E  C  -       SEQ ID NO: 813

CTGGTCCGTTTGCAAAGACCTGTTCGGTGTTGACCGTGGTAAATGCATGGGTAAAAAATG
61 ---------+---------+---------+---------+---------+---------+  120
    GACGAGGCAAACGTTTCTGGACAAGCCACAACTGGCACCATTTACGTACCCATTTTTAC
    W  S  V  C  K  D  L  F  G  V  D  R  G  K  C  M  G  K  K  C  -

CCGTTGCTACCAG
121 ---------+---
    GGCAACGATGGTCATTC
    R  C  Y  Q  -
```

Oligos used to form duplex are shown below:

```
TGGTTCCGGTGGTGGTGGTTCCGAATGCCGTTACCTGTTCGGTGGTTG;                                    //SEQ ID NO: 815

CAAAACCACCTCCGACTGCTGCAAACACCTGGGTTGCAAATTCCGTGACAAATACTGCGCTTGGGACTTCACC           //SEQ ID NO: 816
TTCTCC;

CTTAGGAGAAGGTGAAGTCCCAAGCGCAGTATTTGTCACGGAATTTGC;                                   //SEQ ID NO: 817

AACCCAGGTGTTTGCAGCAGTCGGAGGTGGTTTTGCAACCACCGAACAGGTAACGGCATTCGGAACCACCACC           //SEQ ID NO: 818
ACCGGA;
```

The oligos above were used to form the duplex below:

```
    TGGTTCCGGTGGTGGTGGTTCCGAATGCCGTTACCTGTTCGGTGGTTGCAAAACCACCTC          SEQ ID NO: 819
 1---------+---------+---------+---------+---------+---------+     60
       AGGCCACCACCACCAAGGCTTACGGCAATGGACAAGCCACCAACGTTTTGGTGGAG             SEQ ID NO: 821
     G  S  G  G  G  G  S  E  C  R  Y  L  F  G  G  C  K  T  T  S  -         SEQ ID NO: 820

CGACTGCTGCAAACACCTGGGTTGCAAATTCCGTGACAAATACTGCGCTTGGGACTTCAC
61---------+---------+---------+---------+---------+---------+    120
    GCTGACGACGTTTGTGGACCCAACGTTTAAGGCACTGTTTATGACGCGAACCCTGAAGTG
     D  C  C  K  H  L  G  C  K  F  R  D  K  Y  C  A  W  D  F  T  -

CTTCTCC
121-------
     GAAGAGGATTC
      F  S  -
```

Bacterial expression of the peptibody was as described in Example 3 and paste was stored frozen.

Refolding and purification of Fc-L-HaTx1 expressed in bacteria. Frozen, *E. coli* paste (13 g) was combined with 100 ml of room temperature 50 mM tris HCl, 5 mM EDTA, pH 8.0 and was brought to about 0.1 mg/ml hen egg white lysozyme. The suspended paste was passed through a chilled microfluidizer twice at 12,000 PSI. The cell lysate was then centrifuged at 22,000 g for 20 min at 4° C. The pellet was then resuspended in 200 ml 1% deoxycholic acid using a tissue grinder and then centrifuged at 22,000 g for 20 min at 4° C. The pellet was then resuspended in 200 ml water using a tissue grinder and then centrifuged at 22,000 g for 20 min at 4° C. The pellet (2.6 g) was then dissolved in 26 ml 8 M guanidine HCl, 50 mM tris HCl, pH 8.0. The dissolved pellet was then reduced by adding 30 µl 1 M dithiothreitol to 3 ml of the solution and incubating at 37° C. for 30 minutes. The reduced pellet solution was then centrifuged at 14,000 g for 5 min at room temperature, and then 2.5 ml of the supernatant was transferred to 250 ml of the refolding buffer (2 M urea, 50 mM tris, 160 mM arginine HCl, 5 mM EDTA, 1 mM cystamine HCl, 4 mM cysteine, pH 8.5) at 4° C. with vigorous stirring. The stirring rate was then slowed and the incubation was continued for 2 days at 4° C. The refolding solution was then filtered through a 0.22 µm cellulose acetate filter and stored at −70° C.

The stored refold was defrosted and then diluted with 1 L of water and the pH was adjusted to 7.5 using 1 M $H_3PO_4$. The pH adjusted material was then filtered through a 0.22 µm cellulose acetate filter and loaded on to a 10 ml Amersham SP-HP HiTrap column at 10 ml/min in S-Buffer A (20 mM $NaH_2PO_4$, pH 7.3) at 7° C. The column was then washed with several column volumes of S-Buffer A, followed by elution with a linear gradient from 0% to 60% S-Buffer B (20 mM $NaH_2PO_4$, 1 M NaCl, pH 7.3) followed by a step to 100% S-Buffer B at 5 ml/min at 7° C. Fractions were then analyzed using a Coomassie brilliant blue stained tris-glycine 4-20% SDS-PAGE, and the fractions containing the desired product were pooled based on these data (15 ml). The pool was then loaded on to a 1 ml Amersham rProtein A HiTrap column in PBS at 2 ml/min 7° C. Then column was then washed with several column volumes of 20 mM $NaH_2PO_4$ pH 6.5, 1 M NaCl and eluted with 100 mM glycine pH 3.0. To the elution peak (1.4 ml), 70 µl 1 M tris HCl pH 8.5 was added, and then the pH adjusted material was filtered though a 0.22 µm cellulose acetate filter.

A spectral scan was then conducted on 20 µl of the combined pool diluted in 700 µl PBS using a Hewlett Packard 8453 spectrophotometer (FIG. 29F). The concentration of the filtered material was determined to be 1.44 mg/ml using a calculated molecular mass of 30,469 g/mol and extinction coefficient of 43,890 $M^{-1}$ $cm^{-1}$. The purity of the filtered material was then assessed using a Coomassie brilliant blue stained tris-glycine 4-20% SDS-PAGE (FIG. 29B). The endotoxin level was then determined using a Charles River Laboratories Endosafe-PTS system (0.05-5 EU/ml sensitivity) using a 33-fold dilution of the sample in Charles Rivers Endotoxin Specific Buffer BG120 yielding a result of <4 EU/mg protein. The macromolecular state of the product was then determined using size exclusion chromatography on 20 µg of the product injected on to a Phenomenex BioSep SEC 3000 column (7.8×300 mm) in 50 mM $NaH_2PO_4$, 250 mM NaCl, pH 6.9 at 1 ml/min observing the absorbance at 280 nm (FIG. 29G). The product was then subject to mass spectral analysis by diluting 1 µl of the sample into 10 µl of sinapinic acid (10 mg per ml in 0.05% trifluroacetic acid, 50% acetonitrile). The resultant solution (1 µl) was spotted onto a MALDI sample plate. The sample was allowed to dry before being analyzed using a Voyager DE-RP time-of-flight mass spectrometer equipped with a nitrogen laser (337 nm, 3 ns pulse). The positive ion/linear mode was used, with an accelerating voltage of 25 kV. Each spectrum was produced by accumulating data from ~200 laser shots. External mass calibration was accomplished using purified proteins of known molecular masses (FIG. 29H) and these studies confirmed the integrity of the purified peptibody, within experimental error. The product was then stored at −80° C.

Example 24

Fc-L-PaTx2 Bacterial Expression

Bacterial expression of Fc-L-PaTx2. The methods to clone and express the peptibody in bacteria are described in Example 3. The vector used was pAMG21ampR-Fc-Pep and the oligos listed below were used to generate a duplex (see below) for cloning and expression in bacteria of Fc-L-PaTx2.

Oligos used to form duplex are shown below:

```
TGGTTCCGGTGGTGGTGGTTCCTACTGCCAGAAATGGA;                                          //SEQ ID NO: 822

TGTGGACCTGCGACGAAGAACGTAAATGCTGCGAAGGTCTGGTTTGCCGTCTGTGGTGCAAACGTATCATCAA       //SEQ ID NO: 823
CATG;

CTTACATGTTGATGATACGTTTGCACCACAGACGGCAAA;                                         //SEQ ID NO: 824

CCAGACCTTCGCAGCATTTACGTTCTTCGTCGCAGGTCCACATCCATTTCTGGCAGTAGGAACCACCACCAGC       //SEQ ID NO: 825
GGA;
```

The oligos above were used to form the duplex below:

```
    TGGTTCCGGTGGTGGTGGTTCCTACTGCCAGAAATGGATGTGGACCTGCGACGAAGAACG        SEQ ID NO: 826
1 ---------+---------+---------+---------+---------+---------+    60
       AGGCCACCACCACCAAGGATGACGGTCTTTACCTACACCTGGACGCTGCTTCTTGC          SEQ ID NO: 828
     G  S  G  G  G  S  Y  C  Q  K  W  M  W  T  C  D  E  E  R  -        SEQ ID NO: 827

TAAATGCTGCGAAGGTCTGGTTTGCCGTCTGTGGTGCAAACGTATCATCAACATG
61 ---------+---------+---------+---------+---------+-----
    ATTTACGACGCTTCCAGACCAAACGGCAGACACCACGTTTGCATAGTAGTTGTACATTC
      K  C  C  E  G  L  V  C  R  L  W  C  K  R  I  I  N  M  -
```

Bacterial expression of the peptibody was as described in Example 3 and paste was stored frozen.

Example 25

Fc-L-wGVIA Bacterial Expression

Bacterial expression of Fc-L-wGVIA. The methods to clone and express the peptibody in bacteria are described in Example 3. The vector used was pAMG21ampR-Fc-Pep and the oligos listed below were used to generate a duplex (see below) for cloning and expression in bacteria of Fc-L-wGVIA.

Oligos used to form duplex are shown below:

```
TGGTTCCGGTGGTGGTGGTTCCTGCAAATCCCCGGGTT;                                          //SEQ ID NO: 829

CCTCCTGCTCCCCGACCTCCTACAACTGCTGCCGTTCCTGCAACCCGTACACCAAACGTTGCTACGGT;           SEQ ID NO: 830

CTTAACCGTAGCAACGTTTGGTGTACGGGTTGCAGGAA;                                          //SEQ ID NO: 831

CGGCAGCAGTTGTAGGAGGTCGGGGAGCAGGAGGAACCCGGGGATTTGCAGGAACCACCACCACCGGA;           //SEQ ID NO: 832
```

The oligos above were used to form the duplex below:

```
    TGGTTCCGGTGGTGGTGGTTCCTGCAAATCCCCGGGTTCCTCCTGCTCCCCGACCTCCTA         SEQ ID NO: 833
1 ---------+---------+---------+---------+---------+---------+    60
       AGGCCACCACCACCAAGGACGTTTAGGGGCCCAAGGAGGACGAGGGGCTGGAGGAT            SEQ ID NO: 835
```

```
    G  S  G  G  G  G  S  C  K  S  P  G  S  S  C  S  P  T  S  Y  -          SEQ ID NO: 834

CAACTGCTGCCGTTCCTGCAACCCGTACACCAAACGTTGCTACGGT
61  ---------+---------+---------+---------+------
    GTTGACGACGGCAAGGACGTTGGGCATGTGGTTTGCAACGATGCCAATTC
     N  C  C  R  S  C  N  P  Y  T  K  R  C  Y  G
```

Bacterial expression of the peptibody was as described in Example 3 and paste was stored frozen.

Example 26

Fc-L-ωMVIIA Bacterial Expression

Bacterial expression of Fc-L-ωMVIIA. The methods to clone and express the peptibody in bacteria are described in Example 3. The vector used was pAMG21ampR-Fc-Pep and the oligos listed below were used to generate a duplex (see below) for cloning and expression in bacteria of Fc-L-ωMVIIA.

Oligos used to form duplex are shown below:

TGGTTCCGGTGGTGGTGGTTCCTGCAAAGGTAAA;                //SEQ ID NO: 836

GGTGCTAAATGCTCCCGTCTGATGTAC-
GACTGCTGCACCGGTTCCTGCCGTTCCGGTAAATGCGGT;           //SEQ ID NO: 837

CTTAACCGCATTTACCGGAACGGCAGGAACCGGT;                //SEQ ID NO: 838

GCAGCAGTCGTACATCAGACGGGAG-
CATTTAGCACCTTTACCTTTGCAGGAACCACCACCACCGGA;         //SEQ ID NO: 839

The oligos above were used to form the duplex below:

```
    TGGTTCCGGTGGTGGTGGTTCCTGCAAAGGTAAAGGTGCTAAATGCTCCCGTCTGATGTA      SEQ ID NO: 840
1   ---------+---------+---------+---------+---------+---------+   60
        AGGCCACCACCACCAAGGACGTTTCCATTTCCACGATTTACGAGGGCAGACTACAT       SEQ ID NO: 842
     G  S  G  G  G  G  S  C  K  G  K  G  A  K  C  S  R  L  M  Y  -  SEQ ID NO: 841

CGACTGCTGCACCGGTTCCTGCCGTTCCGGTAAATGCGGT
61  ---------+---------+---------+---------+
    GCTGACGACGTGGCCAAGGACGGCAAGGCCATTTACGCCAATTC
     D  C  C  T  G  S  C  R  S  G  K  C  G  -
```

Bacterial expression of the peptibody was as described in Example 3 and paste was stored frozen.

Example 27

Fc-L-Ptu1 Bacterial Expression

Bacterial expression of Fc-L-Ptu1. The methods to clone and express the peptibody in bacteria are described in Example 3. The vector used was pAMG21ampR-Fc-Pep and the oligos listed below were used to generate a duplex (see below) for cloning and expression in bacteria of Fc-L-Ptu1.

Oligos used to form duplex are shown below:

TGGTTCCGGTGGTGGTGGTTCCGCTGAAAAAGACTGCATC;                                //SEQ ID NO: 843

GCTCCGGGTGCTCCGTGCTTCGGTACCGACAAACCGTGCTGCAACCCGCGTGCTTGGTGCTCCTCCTACGCTA //SEQ ID NO: 844
ACAAATGCCTG;

-continued

```
CTTACAGGCATTTGTTAGCGTAGGAGGAGCACCAAGCACG;                                      //SEQ ID NO: 845

CGGGTTGCAGCACGGTTTGTCGGTACCGAAGCACGGAGCACCCGGAGCGATGCAGTCTTTTTCAGCGGAACCA     //SEQ ID NO: 846
CCACCACCGGA;
```

The oligos above were used to form the duplex below:

```
    TGGTTCCGGTGGTGGTGGTTCCGCTGAAAAAGACTGCATCGCTCCGGGTGCTCCGTGCTT        SEQ ID NO: 847
 1---------+---------+---------+---------+---------+---------+   60
        AGGCCACCACCACCAAGGCGACTTTTTCTGACGTAGCGAGGCCCACGAGGCACGAA         SEQ ID NO: 849
     G   S   G   G   G   G   S   A   E   K   D   C   I   A   P   G   A   P   C   F   -    SEQ ID NO: 848

CGGTACCGACAAACCGTGCTGCAACCCGCGTGCTTGGTGCTCCTCCTACGCTAACAAATG
61---------+---------+---------+---------+---------+---------+  120
    GCCATGGCTGTTTGGCACGACGTTGGGCGCACGAACCACGAGGAGGATGCGATTGTTTAC
      G   T   K   D   P   C   C   N   P   R   A   W   C   S   S   Y   A   N   K   C   -

CCTG
121----
    GGACATTC
      L   -
```

Bacterial expression of the peptibody was as described in Example 3 and paste was stored frozen.

Example 28

Fc-L-ProTx1 Bacterial Expression

Bacterial expression of Fc-L-ProTx1. The methods to clone and express the peptibody in bacteria are described in Example 3. The vector used was pAMG21ampR-Fc-Pep and the oligos listed below were used to generate a duplex (see below) for cloning and expression in bacteria of Fc-L-ProTx1.

Oligos used to form duplex are shown below:

```
TGGTTCCGGTGGTGGTGGTTCCGAATGCCGTTACTGGCTGG;                                          //SEQ ID NO: 850

GTGGTTGCTCCGCTGGTCAGACCTGCTGCAAACACCTGGTTTGCTCCCGTCGTCACGGTTGGTGCGTTTGGGA          //SEQ ID NO: 851
CGGTACCTTCTCC;

CTTAGGAGAAGGTACCGTCCCAAACGCACCAACCGTGACGA;                                          //SEQ ID NO: 852

CGGGAGCAAACCAGGTGTTTGCAGCAGGTCTGACCAGCGGAGCAACCACCCAGCCAGTAACGGCATTCGGAAC          //SEQ ID NO: 853
CACCACCACCGGA;
```

Bacterial expression of the peptibody was as described in Example 3 and paste was stored frozen.

Example 29

Fc-L-BeKM1 Bacterial Expression

Bacterial expression of Fc-L-BeKM1. The methods to clone and express the peptibody in bacteria are described in Example 3. The vector used was pAMG21ampR-Fc-Pep and the oligos listed below were used to generate a duplex (see below) for cloning and expression in bacteria of Fc-L-BeKM1.

The oligos above were used to form the duplex below:

```
    TGGTTCCGGTGGTGGTGGTTCCGAATGCCGTTACTGGCTGGGTGGTTGCTCCGCTGGTCA        SEQ ID NO: 854
 1---------+---------+---------+---------+---------+---------+   60
        AGGCCACCACCACCAAGGCTTACGGCAATGACCGACCCACCAACGAGGCGACCAGT         SEQ ID NO: 856
     G   S   G   G   G   G   S   E   C   R   Y   W   L   G   G   C   S   A   G   Q   -    SEQ ID NO: 855

GACCTGCTGCAAACACCTGGTTTGCTCCCGTCGTCACGGTTGGTGCGTTTGGGACGGTAC
61---------+---------+---------+---------+---------+---------+  120
    CTGGACGACGTTTGTGGACCAAACGAGGGCAGCAGTGCCAACCACGCAAACCCTGCCATG
      T   C   C   K   H   L   V   C   S   R   R   H   G   W   C   V   W   D   G   T   -

CTTCTCC
121-------
    GAAGAGGATTC
      F   S   -
```

Oligos used to form duplex are shown below:

TGGTTCCGGTGGTGGTGGTTCCCGTCCGACCGACATCAAATG; //SEQ ID NO: 857

CTCCGAATCCTACCAGTGCTTCCCGGTTTGCAAATCCCGTTTCGGTAAAACCAACGGTCGTTGCGTTAACGGT //SEQ ID NO: 858
TTCTGCGACTGCTTC;

CTTAGAAGCAGTCGCAGAAACCGTTAACGCAACGACCGTTGG; //SEQ ID NO: 859

TTTTACCGAAACGGGATTTGCAAACCGGGAAGCACTGGTAGGATTCGGAGCATTTGATGTCGGTCGGACGGGA //SEQ ID NO: 860
ACCACCACCACCGGA;

The oligos above were used to form the duplex below:

```
   TGGTTCCGGTGGTGGTGGTTCCCGTCCGACCGACATCAAATGCTCCGAATCCTACCAGTG      SEQ ID NO: 861
1---------+---------+---------+---------+---------+---------+   60
       AGGCCACCACCACCAAGGGCAGGCTGGCTGTAGTTTACGAGGCTTAGGATGGTCAC      SEQ ID NO: 863
    G  S  G  G  G  G  S  R  P  T  D  I  K  C  S  E  S  Y  Q  C  -   SEQ ID NO: 862

CTTCCCGGTTTGCAAATCCCGTTTCGGTAAAACCAACGGTCGTTGCGTTAACGGTTTCTG
61 ---------+---------+---------+---------+---------+---------+  120
    GAAGGGCCAAACGTTTAGGGCAAAGCCATTTTGGTTGCCAGCAACGCAATTGCCAAAGAC
     F  P  V  C  K  S  R  F  G  K  T  N  G  R  C  V  N  G  F  C  -

CGACTGCTTC
121---------+
    GCTGACGAAGATTC
     D  C  F  -
```

Bacterial expression of the peptibody was as described in Example 3 and paste was stored frozen.

Example 30

Fc-L-CTX Bacterial Expression

Bacterial expression of Fc-L-CTX. The methods to clone and express the peptibody in bacteria are described in Example 3. The vector used was pAMG21ampR-Fc-Pep and the oligos listed below were used to generate a duplex (see below) for cloning and expression in bacteria of Fc-L-CTX.

Oligos used to form duplex are shown below:

TGGTTCCGGTGGTGGTGGTTCCATGTGCATGCCGTGCTTCAC; //SEQ ID NO: 864

CACCGACCACCAGATGGCTCGTAAATGCGACGACTGCTGCGGTGGTAAAGGTCGTGGTAAATGCTACGGTCCG //SEQ ID NO: 865
CAGTGCCTGTGCCGT;

CTTAACGGCACAGGCACTGCGGACCGTAGCATTTACCACGAC; //SEQ ID NO: 866

CTTTACCACCGCAGCAGTCGTCGCATTTACGAGCCATCTGGTGGTCGGTGGTGAAGCACGGCATGCACATGGA //SEQ ID NO: 867
ACCACCACCACCGGA;

The oligos above were used to form the duplex below:

```
   TGGTTCCGGTGGTGGTGGTTCCATGTGCATGCCGTGCTTCACCACCGACCACCAGATGGC      SEQ ID NO: 868
1 ---------+---------+---------+---------+---------+---------+   60
       AGGCCACCACCACCAAGGTACACGTACGGCACGAAGTGGTGGCTGTGGTCTACCG       SEQ ID NO: 870
    G  S  G  G  G  G  S  M  C  M  P  C  F  T  T  D  H  Q  M  A  -   SEQ ID NO: 869

TCGTAAATGCGACGACTGCTGCGGTGGTAAAGGTCGTGGTAAATGCTACGGTCCGCAGTG
61 ---------+---------+---------+---------+---------+---------+  120
    AGCATTTACGCTGCTGACGACGCCACCATTTCCAGCACCATTTACGATGCCAGGCGTCAC
     R  K  C  D  D  C  C  G  G  K  G  R  G  K  C  Y  G  P  Q  C  -

CCTGTGCCGT
```

```
121---------+
   GGACACGGCACCAC
     L  C  R  -
```

Bacterial expression of the peptibody was as described in Example 3 and paste was stored frozen.

Example 31

N-Terminally PEGylated-Des-Arg1-ShK

Peptide Synthesis of reduced Des-Arg1-ShK. Des-Arg1-ShK, having the sequence (Peptide 1, SEQ ID NO: 92)
SCIDTIPKSRCTAFQCKHSMKYRLSFCRKTCGTC was synthesized in a stepwise manner on a Symphony™ multi-peptide synthesizer by solid-phase peptide synthesis (SPPS) using 2-(1H-benzotriazole-1-yl)-1,1,3,3-tetramethyluronium hexafluorophosphate (HBTU)/N-methyl morpholine (NMM)/N,N-dimethyl-formamide (DMF) coupling chemistry at 0.1 mmol equivalent resin scale on Tentagel™-S PHB Fmoc-Cys(Trt)-resin. N-alpha-(9-fluorenylmethyloxycarbonyl)- and side-chain protected amino acids were purchased from Midwest Biotech Incorporated. Fmoc-Cys(Trt)-Tentagel™ resin was purchased from Fluka. The following side-chain protection strategy was employed: Asp(O$^t$Bu), Arg(Pbf), Cys(Trt), Gln(Trt), His(Trt), Lys(N$^\epsilon$-Boc), Ser (O$^t$Bu), Thr(O$^t$Bu) and Tyr(O$^t$Bu). Two Oxazolidine dipeptides, Fmoc-Gly-Thr($^{\psi Me, Me}$Pro)-OH and Fmoc-Leu-Ser ($^{\psi Me, Me}$Pro)-OH, were used in the chain assembly and were obtained from NovaBiochem and used in the synthesis of the sequence. The protected amino acid derivatives (20 mmol) were dissolved in 100 ml 20% dimethyl sulfoxide (DMSO) in DMF (v/v). Protected amino acids were activated with 20 mM HBTU, 400 mM NMM in 20% DMSO in DMF, and coupling were carried out using two treatments with 0.5 mmol protected amino acid, 0.5 mmol HBTU, 1 mmol NMM in 20% DMF/DMSO for 25 minutes and then 40 minutes. Fmoc deprotection reactions were carried out with two treatments using a 20% piperidine in DMF (v/v) solution for 10 minutes and then 15 minutes. Following synthesis, the resin was then drained, and washed with DCM, DMF, DCM, and then dried in vacuo. The peptide-resin was deprotected and released from the resin by treatment with a TFA/EDT/TIS/H$_2$O (92.5:2.5:2.5:2.5 (v/v)) solution at room temperature for 1 hour. The volatiles were then removed with a stream of nitrogen gas, the crude peptide precipitated twice with cold diethyl ether and collected by centrifugation. The crude peptide was then analyzed on a Waters 2795 analytical RP-HPLC system using a linear gradient (0-60% buffer B in 12 minutes, A: 0.1% TFA in water, B: 0.1% TFA in acetonitrile) on a Jupiter 4 µm Proteo™ 90 Å column. A PE-Sciex™ API Electro-spray mass spectrometer was used to confirm correct peptide product mass. Crude peptide was obtained in 143 mg yield at approximately 70% pure based as estimated by analytical RP-HPLC analysis. Reduced Des-Arg1-ShK (Peptide 1) Retention time (Rt)=5.31 minutes, calculated molecular weight=3904.6917 Da (average); Experimental observed molecular weight 3907.0 Da.

Figure 20A:
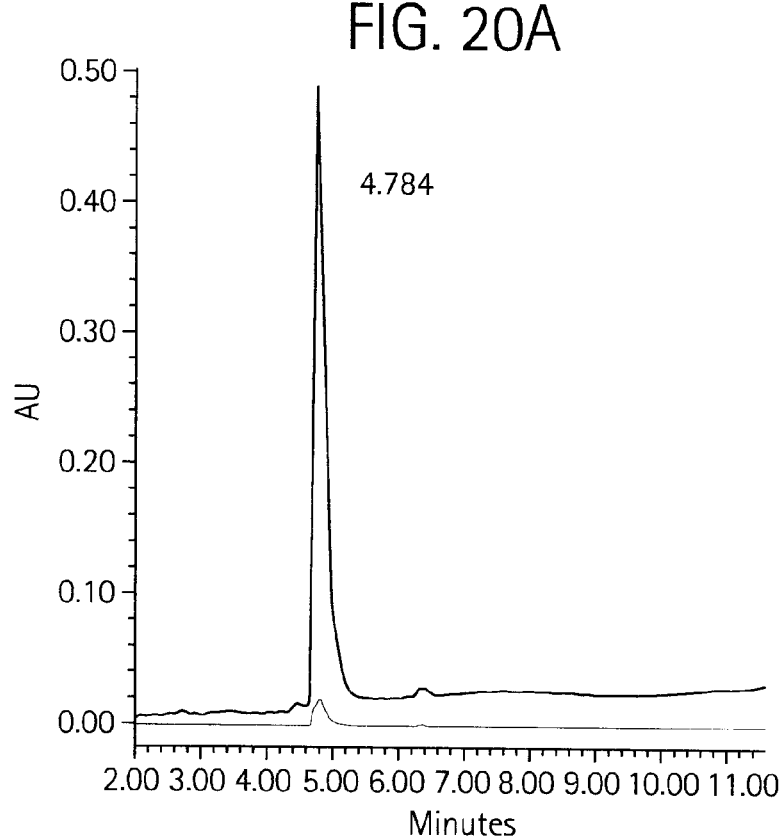
FIG. 20A shows a reversed-phase HPLC analysis at 214 nm and FIG. 20B shows electrospray mass analysis of folded ShK[2-35], also described as folded-"Des-Arg1-ShK" (Peptide 2).
Figure 20B:
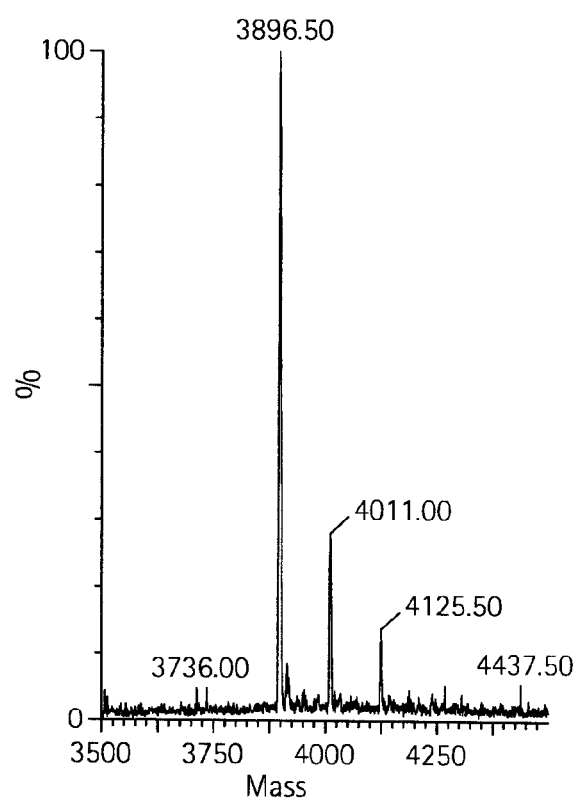
Figure 21:
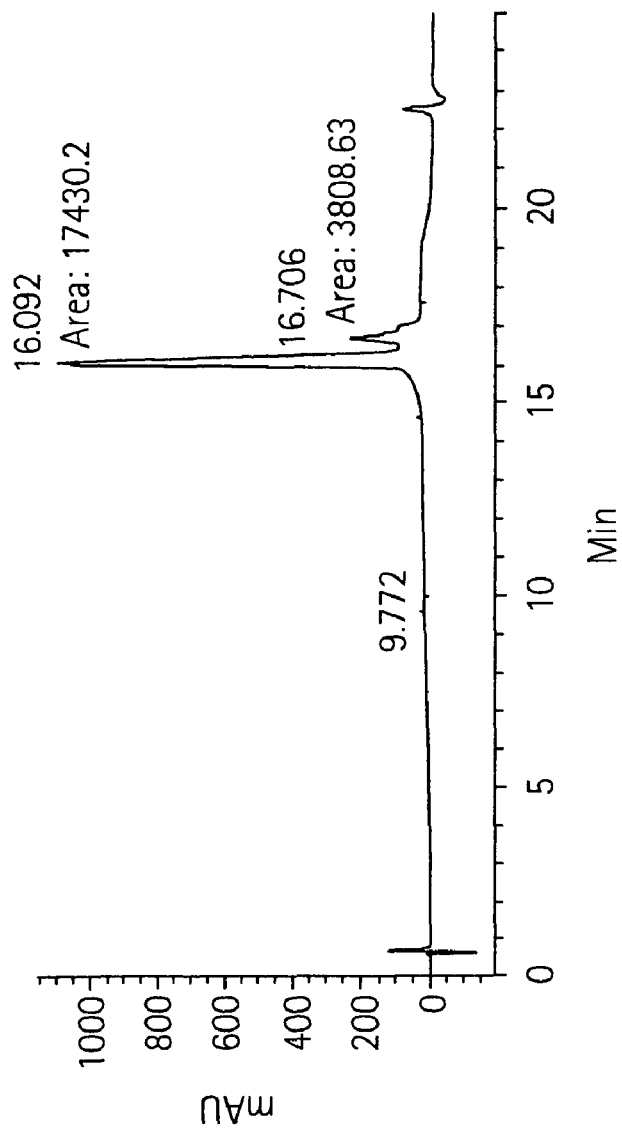
FIG. 21 shows reversed phase HPLC analysis at 214 nm of N-terminally PEGylated ShK[2-35], also referred to as N-Terminally PEGylated-"Des-Arg1-ShK".
Figure 22:
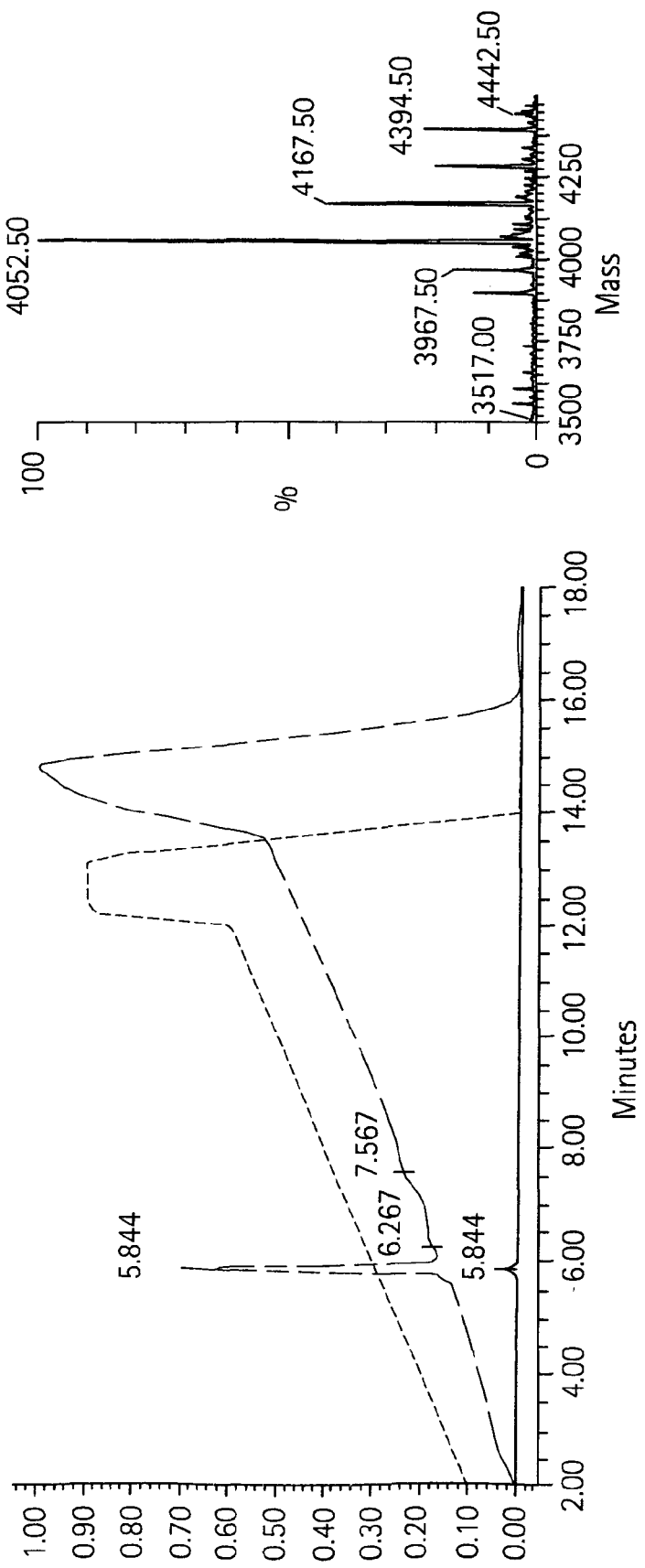
FIG. 22A shows a reversed-phase HPLC analysis at 214 nm of folded ShK[1-35], also referred to as "ShK".
FIG. 22B shows electrospray mass analysis of folded ShK [1-35], also referred to as "ShK".

Folding of Des-Arg1-ShK (Disulphide bond formation). Following TFA cleavage and peptide precipitation, reduced Des-Arg1-ShK was then air-oxidized to give the folded peptide. The crude cleaved peptide was extracted using 20% AcOH in water (v/v) and then diluted with water to a concentration of approximately 0.15 mg reduced Des-Arg1-ShK per mL, the pH adjusted to about 8.0 using NH$_4$OH (28-30%), and gently stirred at room temperature for 36 hours. Folding process was monitored by LC-MS analysis. Following this, folded Des-Arg1-ShK peptide was purified using reversed phase HPLC using a 1" Luna 5 µm C18 100 Å Proteo™ column with a linear gradient 0-40% buffer B in 120 min (A=0.1% TFA in water, B=0.1% TFA in acetonitrile). Folded Des-Arg1-ShK crude peptide eluted earlier (when compared to the elution time in its reduced form) at approximately 25% buffer B. Folded Des-Arg1-ShK (Peptide 2) was obtained in 23.2 mg yield in >97% purity as estimated by analytical RP-HPLC analysis (FIG. 20). Calculated molecular weight=3895.7693 Da (monoisotopic), experimental observed molecular weight=3896.5 Da (analyzed on a Waters LCT Premier Micromass MS Technologies). Des-Arg1-ShK disulfide connectivity was C1-C6, C2-C4, C3-C5.

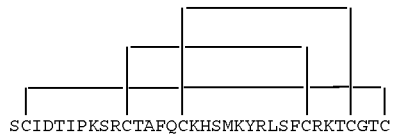

(Peptide 2, SEQ ID NO: 58)

Figure 23:
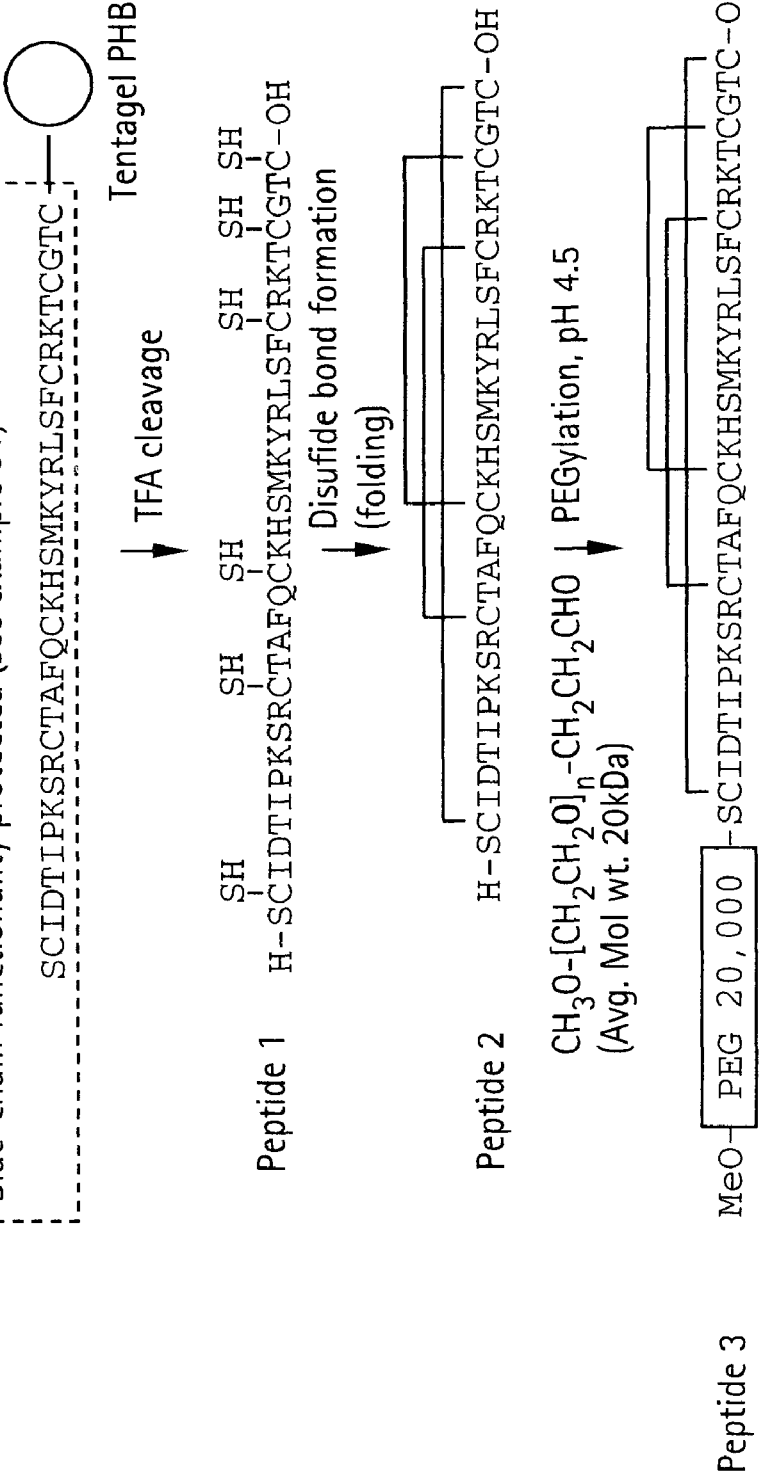
FIG. 23 illustrates a scheme for N-terminal PEGylation of ShK[2-35] (SEQ ID NO: 92 and SEQ ID NO: 58, also referred to as "Des-Arg1-ShK" or "ShK d1") by reductive amination, which is also described in Example 31 hereinafter.

N-terminal PEGylation of Folded Des-Arg1-ShK. Folded Des-Arg1-ShK, (Peptide 2) was dissolved in water at 1 mg/ml concentration. A 2 M MeO-PEG-Aldehyde, CH$_3$O—[CH$_2$CH$_2$O]$_n$—CH$_2$CH$_2$CHO (average molecular weight 20 kDa), solution in 50 mM NaOAc, pH 4.5, and a separate 1 M solution of NaCNBH$_3$ were freshly prepared. The peptide solution was then added to the MeO-PEG-Aldehyde containing solution and was followed by the addition of the NaCNBH$_3$ solution. The reaction stoichiometry was peptide:PEG:NaCNBH3 (1:2:0.02), respectively. The reaction was left for 48 hours, and was analyzed on an Agilent 1100 RP-HPLC system using Zorbax™ 300SB-C8 5 µm column at 40° C. with a linear gradient (6-60% B in 16 minutes, A: 0.1% TFA in water, B: 0.1% TFA/90% ACN in water). Monopegylated folded Des-Arg1-ShK constituted approximately 58% of the crude product by analytical RP-HPLC. Mono Pegylated Des-Arg1-ShK was then isolated using a HiTrap™ 5 ml SP HP cation exchange column on AKTA FPLC system at 4° C. at 1 mL/min using a gradient of 0-50% B in 25 column volumes (Buffers: A=20 mM sodium acetate pH 4.0, B=1 M NaCl, 20 mM sodium acetate, pH 4.0). The fractions were analyzed using a 4-20 tris-Gly SDS-PAGE gel and RP-HPLC (as described for the crude). SDS-PAGE gels were run for 1.5 hours at 125 V, 35 mA, 5 W. Pooled product was then dialyzed at 4° C. in 3 changes of 1 L of A4S buffer (10 mM NaOAc, 5% sorbitol, pH 4.0). The dialyzed product was then concentrated in 10 K microCentrifuge filter to 2 mL volume and sterile-filtered using 0.2 µM syringe filter to give the final product. N-Terminally PEGylated-Des-Arg1-ShK (Peptide 3) was isolated in 1.7 mg yield with 85% purity as estimated by analytical RP-HPLC analysis (FIG. 23).

The N-Terminally PEGylated-Des-Arg1-ShK, also referred to as "PEG-ShK[2-35]", was active in blocking human Kv1.3 (FIG. 38A and FIG. 38B) as determined by patch clamp electrophysiology (Example 36).

Example 32

N-Terminally PEGylated ShK

Figure 17:
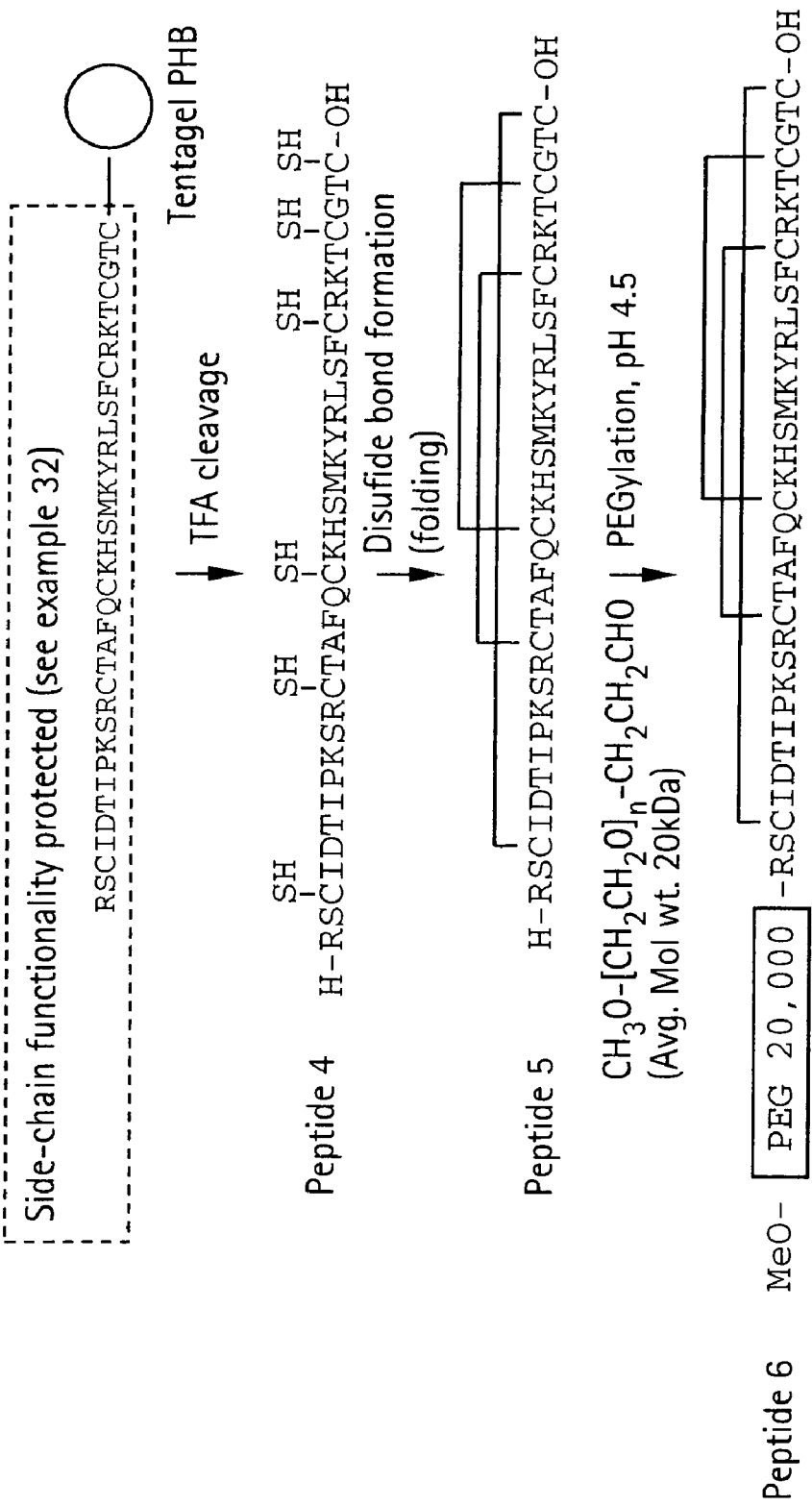
FIG. 17 shows a scheme for N-terminal PEGylation of ShK peptide (SEQ ID NO: 5 and SEQ ID NO:10) by reductive amination, which is also described in Example 32 hereinafter.

The experimental procedures of this working example correspond to the results shown in FIG. 17.

Peptide Synthesis of reduced ShK. ShK, having the amino acid sequence (Peptide 4, SEQ ID NO: 5)
RSCIDTIPKSRCTAFQCKHSMKYRLSFCRKTCGTC was synthesized in a stepwise manner on a Symphony™ multi-peptide synthesizer by solid-phase peptide synthesis (SPPS) using 2-(1H-benzotriazole-1-yl)-1,1,3,3-tetramethyluronium hexafluorophosphate (HBTU)/N-methyl morpholine (NMM)/N,N-dimethyl-formamide (DMF) coupling chemistry at 0.1 mmol equivalent resin scale on Tentagel™-S PHB Fmoc-Cys(Trt)-resin. N-alpha-9-fluorenylmethyloxycarbonyl) and side-chain protected amino acids were purchased from Midwest Biotech Incorporated. Fmoc-Cys(Trt)-Tentagel™ resin was purchased from Fluka. The following side-chain protection strategy was employed: Asp(O$^t$Bu), Arg(Pbf), Cys(Trt), Gln(Trt), His(Trt), Lys(N$^\epsilon$-Boc), Ser (O$^t$Bu), Thr(O$^t$Bu) and Tyr(O$^t$Bu). Two Oxazolidine dipeptides, Fmoc-Gly-Thr($^{\psi Me,\ Me}$Pro)-OH and Fmoc-Leu-Ser ($^{\psi Me,\ Me}$Pro)-OH, were used in the chain assembly and were obtained from NovaBiochem and used in the synthesis of the sequence. The protected amino acid derivatives (20 mmol) were dissolved in 100 ml 20% dimethyl sulfoxide (DMSO) in DMF (v/v). Protected amino acids were activated with 200 mM HBTU, 400 mM NMM in 20% DMSO in DMF, and coupling were carried out using two treatments with 0.5 mmol protected amino acid, 0.5 mmol HBTU, 1 mmol NMM in 20%DMF/DMSO for 25 minutes and then 40 minutes. Fmoc deprotections were carried out with two treatments using a 20% piperidine in DMF (v/v) solution for 10 minutes and then 15 minutes. Following synthesis, the resin was then drained, and washed with DCM, DMF, DCM, and then dried in vacuo. The peptide-resin was deprotected and released from the resin by treatment with a TFA/EDT/TIS/H$_2$O (92.5:2.5:2.5:2.5 (v/v)) solution at room temperature for 1 hour. The volatiles were then removed with a stream of nitrogen gas, the crude peptide precipitated twice with cold diethyl ether and collected by centrifugation. The crude peptide was then analyzed on a Waters 2795 analytical RP-HPLC system using a linear gradient (0-60% buffer B in 12 minutes, A: 0.1% TFA in water, B: 0.1% TFA in acetonitrile) on a Jupiter 4 µm Proteo™ 90 Å column. A PE-Sciex API Electro-spray mass spectrometer was used to confirm correct peptide product mass. Crude peptide was approximately was obtained 170 mg yield at about 45% purity as estimated by analytical RP-HPLC analysis. Reduced ShK (Peptide 4) Retention time (Rt)=5.054 minutes, calculated molecular weight=4060.8793 Da (average); experimental observed molecular weight=4063.0 Da.

Folding of ShK (Disulphide bond formation). Following TFA cleavage and peptide precipitation, reduced ShK was then air oxidized to give the folded peptide. The crude cleaved peptide was extracted using 20% AcOH in water (v/v) and then diluted with water to a concentration of approximately 0.15 mg reduced ShK per mL, the pH adjusted to about 8.0 using NH$_4$OH (28-30%), and gently stirred at room temperature for 36 hours. Folding process was monitored by LC-MS analysis. Following this, folded ShK peptide was purified by reversed phase HPLC using a 1" Luna 5 µm C18 100 Å Proteo™ column with a linear gradient 0-40% buffer B in 120 min (A=0.1% TFA in water, B=0.1% TFA in acetonitrile). Folded ShK crude peptide eluted earlier (when compared to the elution time in its reduced form) at approximately 25% buffer B. Folded ShK (Peptide 5) was obtained in 25.5 mg yield in >97% purity as estimated by analytical RP-HPLC analysis. See FIG. 60. Calculated molecular weight=4051.8764 Da (monoisotopic); experimental observed molecular weight=4052.5 Da (analyzed on Waters LCT Premier Micromass MS Technologies). ShK disulfide connectivity was C1-C6, C2-C4, and C3-C5.

(Peptide 5, SEQ ID NO: 10)

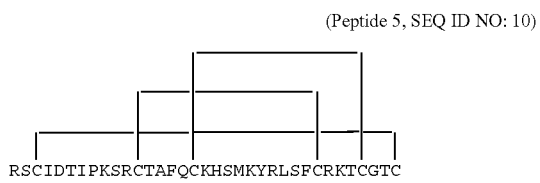

N-terminal PEGylation of Folded ShK. Folded ShK, having the amino acid sequence (SEQ ID NO: 5)
RSCIDTIPKSRCTAFQCKHSMKYRLSFCRKTCGTC can be dissolved in water at 1 mg/ml concentration. A 2 M MeO-PEG-Aldehyde, CH$_3$O—CH$_2$CH$_2$O]$_n$—CH$_2$CH$_2$CHO (average molecular weight 20 kDa), solution in 50 mM NaOAc, pH 4.5 and a separate 1 M solution of NaCNBH$_3$ can be freshly prepared. The peptide solution can be then added to the MeO-PEG-Aldehyde containing solution and can be followed by the addition of the NaCNBH$_3$ solution. The reaction stoichiometry can be peptide:PEG:NaCNBH3 (1:2:0.02), respectively. The reaction can be left for 48 hours, and can be analyzed on an Agilent™ 1100 RP-HPLC system using Zorbax™ 300SB-C8 5 µm column at 40° C. with a linear gradient (6-60% B in 16 minutes, A: 0.1% TFA in water, B: 0.1% TFA/90% ACN in water). Monopegylated Shk (Peptide 6) can be then isolated using a HiTrap™ 5 mL SP HP cation exchange column on AKTA FPLC system at 4° C at 1 mL/min using a gradient of 0-50% B in 25 column volumes (Buffers: A=20 mM sodium acetate pH 4.0, B=1 M NaCl, 20 mM sodium acetate, pH 4.0). The fractions can be analyzed using a 4-20 tris-Gly SDS-PAGE gel and RP-HPLC. SDS-PAGE gels can be run for 1.5 hours at 125 V, 35 mA, 5 W. Pooled product can be then dialyzed at 4° C. in 3 changes of 1 L of A4S buffer (10 mM sodium acetate, 5% sorbitol, pH 4.0). The dialyzed product can be then concentrated in 10 K microCentrifuge filter to 2 mL volume and sterile-filtered using 0.2 µM syringe filter to give the final product.

Example 33

N-Terminally PEGylated ShK by Oxime Formation

Peptide Synthesis of reduced ShK. ShK, having the sequence (SEQ ID NO: 5)
RSCIDTIPKSRCTAFQCKHSMKYRLSFCRKTCGTC can be synthesized in a stepwise manner on a Symphony™ multi-peptide synthesizer by solid-phase peptide synthesis (SPPS) using 2-(1H-benzotriazole-1-yl)-1,1,3,3-tetramethyluronium hexafluorophosphate (HBTU)/N-methyl morpholine (NMM)/N,N-dimethyl-formamide (DMF) coupling chemistry at 0.1 mmol equivalent resin scale on Tentagel™-S PHB Fmoc-Cys(Trt)-resin. N-alpha-(9-fluorenylmethyloxycarbonyl)- and side-chain protected amino acids can be purchased from Midwest Biotech Incorporated. Fmoc-Cys(Trt)-Tentagel™ resin can be purchased from Fluka. The following side-chain protection strategy can be employed: Asp(O$^t$Bu), Arg(Pbf), Cys(Trt), Gln(Trt), His(Trt), Lys(N$^\epsilon$-Boc), Ser (O$^t$Bu), Thr(O$^t$Bu) and Tyr(O$^t$Bu). Two Oxazolidine dipeptides, Fmoc-Gly-Thr($\Psi^{Me,\ Me}$Pro)-OH and Fmoc-Leu-Ser ($\psi^{Me,\ Me}$Pro)-OH, can be used in the chain assembly and can be obtained from NovaBiochem and used in the synthesis of the sequence. The protected amino acid derivatives (20 mmol) can be dissolved in 100 ml 20% dimethyl sulfoxide (DMSO) in DMF (v/v). Protected amino acids can be activated with 200 mM HBTU, 400 mM NMM in 20% DMSO in DMF, and coupling can be carried out using two treatments with 0.5 mmol protected amino acid, 0.5 mmol HBTU, 1 mmol NMM in 20% DMF/DMSO for 25 minutes and then 40 minutes. Fmoc deprotection reactions can be carried out with two treatments using a 20% piperidine in DMF (v/v) solution for 10 minutes and then 15 minutes. Following the chain-assembly of the Shk peptide, Boc-amionooxyacetic acid (1.2 equiv) can be coupled at the N-terminus using 0.5 M HBTU in DMF with 4 equiv collidine for 5 minutes. Following synthesis, the resin can be then drained, and washed with DCM, DMF, DCM, and then dried in vacuo. The peptide-resin can be deprotected and released from the resin by treatment with a TFA/amionooxyacetic acid/TIS/EDT/H2O (90: 2.5:2.5:2.5:2.5) solution at room temperature for 1 hour. The volatiles can be then removed with a stream of nitrogen gas, the crude peptide precipitated twice with cold diethyl ether and collected by centrifugation. The aminooxy-Shk peptide (Peptide 7) can be then analyzed on a Waters 2795 analytical RP-HPLC system using a linear gradient (0-60% buffer B in 12 minutes, A: 0.1% TFA in water also containing 0.1% aminooxyacetic acid, B: 0.1% TFA in acetonitrile) on a Jupiter 4 μm Proteo™ 90 Å column.

Reversed-Phase HPLC Purification. Preparative Reversed-phase high-performance liquid chromatography can be performed on C18, 5 μm, 2.2 cm×25 cm) column. Chromatographic separations can be achieved using linear gradients of buffer B in A (A=0.1% aqueous TFA; B=90% aq. ACN containing 0.09% TFA and 0.1% aminooxyacetic acid), typically 5-95% over 90 minutes at 15 mL/min. Preparative HPLC fractions can be characterized by ESMS and photodiode array (PDA) HPLC, combined and lyophilized.

N-Terminal PEGylation of Shk by Oxime Formation. Lyophilized aminooxy-Shk (Peptide 7) can be dissolved in 50% HPLC buffer A/B (5 mg/mL) and added to a two-fold molar excess of MeO-PEG-Aldehyde, CH$_3$O—[CH$_2$CH$_2$O]$_n$—CH$_2$CH$_2$CHO (average molecular weight 20 kDa). The reaction can be left for 24 hours, and can be analyzed on an Agilent™ 1100 RP-HPLC system using Zorbax™ 300SB-C8 5 μm column at 40° C. with a linear gradient (6-60% B in 16 minutes, A: 0.1% TFA in water, B: 0.1% TFA/90% ACN in water). Mono-pegylated reduced Shk constituted approximately 58% of the crude product by analytical RP-HPLC. Mono PEGylated (oximated) Shk (Peptide 8) can be then isolated using a HiTrap™ 5 mL SP HP cation exchange column on AKTA FPLC system at 4° C. at 1 mL/min using a gradient of 0-50% B in 25 column volumes (Buffers: A=20 mM sodium acetate pH 4.0, B=1 M NaCl, 20 mM sodium acetate, pH 4.0). The fractions can be analyzed using a 4-20 tris-Gly SDS-PAGE gel and RP-HPLC. SDS-PAGE gels can be run for 1.5 hours at 125 V, 35 mA, 5 W. Pooled product can be then dialyzed at 4° C. in 3 changes of 1 L of A4S buffer (10 mM NaOAc, 5% sorbitol, pH 4.0). The dialyzed product can be then concentrated in 10 K microCentrifuge filter to 2 mL volume and sterile-filtered using 0.2 μM syringe filter to give the final product.

Folding of ShK (Disulphide bond formation). The mono-PEGylated (oximated) Shk can be dissolved in 20% AcOH in water (v/v) and can be then diluted with water to a concentration of approximately 0.15 mg peptide mL, the pH adjusted to about 8.0 using NH$_4$OH (28-30%), and gently stirred at room temperature for 36 hours. Folding process can be monitored by LC-MS analysis. Following this, folded mono-PEGylated (oximated) Shk (Peptide 9) can be purified using by reversed phase HPLC using a 1" Luna 5 μm C18 100 Å Proteo™ column with a linear gradient 0-40% buffer B in 120 min (A=0.1% TFA in water, B=0.1% TFA in acetonitrile). Mono-PEGylated (oximated) ShK disulfide connectivity can be C1-C6, C2-C4, and C3-C5.

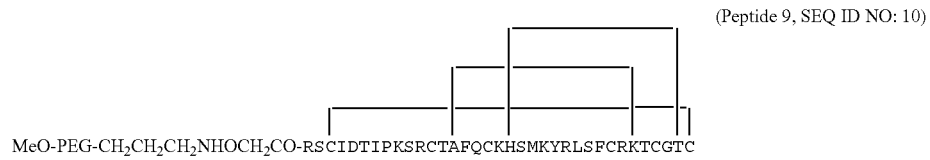

(Peptide 9, SEQ ID NO: 10)

MeO-PEG-CH$_2$CH$_2$CH$_2$NHOCH$_2$CO-RSCIDTIPKSRCTAFQCKHSMKYRLSFCRKTCGTC

Example 34

N-Terminally PEGylated ShK (Amidation)

Figure 18:
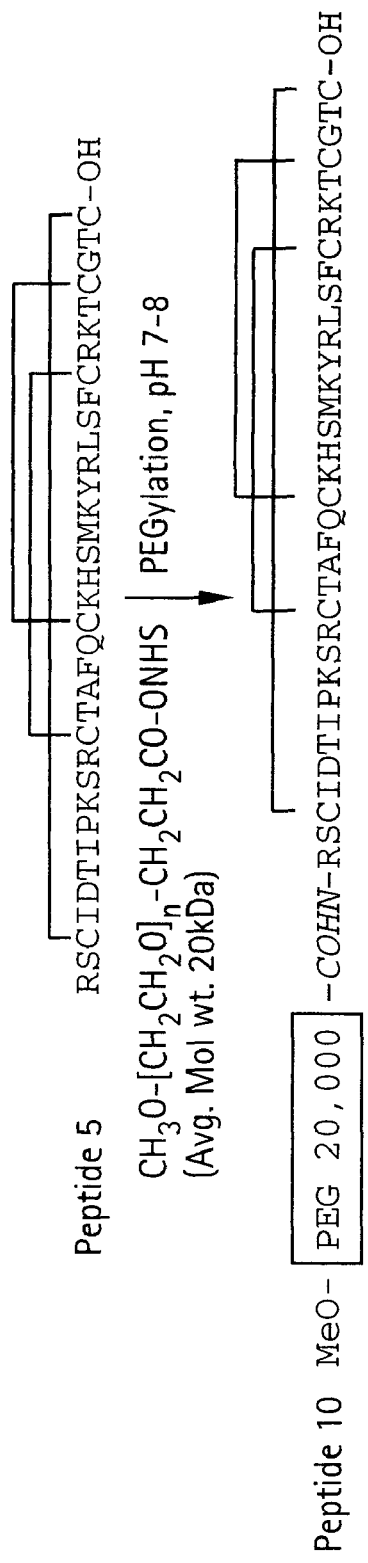
FIG. 18 shows a scheme for N-terminal PEGylation of ShK peptide (SEQ ID NO: 5 and SEQ ID NO:10) via amide formation, which is also described in Example 34 hereinafter.
Figure 19:
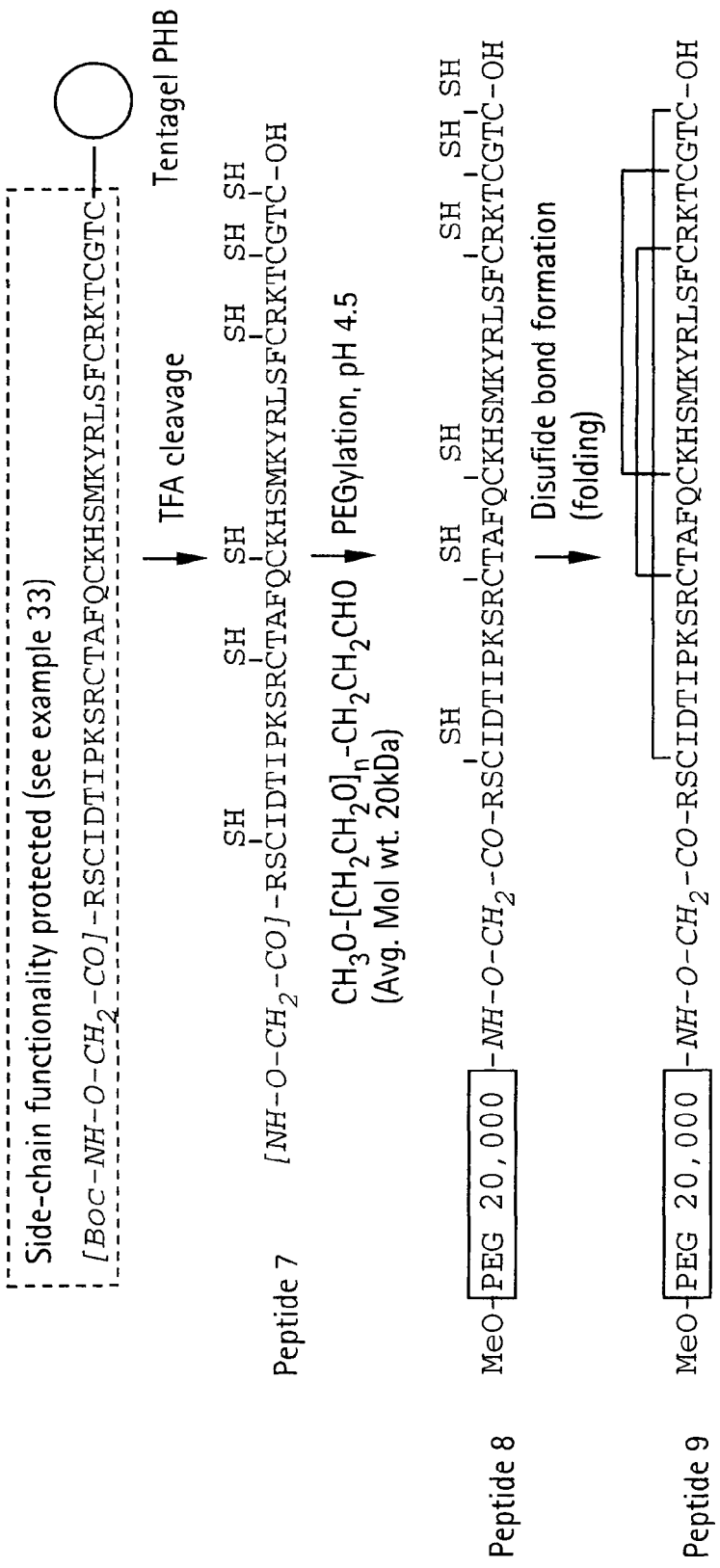
FIG. 19 shows a scheme for N-terminal PEGylation of ShK peptide (SEQ ID NO: 5 and SEQ ID NO:10) by chemoselective oxime formation, which is also described in Example 33 hereinafter.

The experimental procedures of this working example correspond to the results shown in FIG. 18.

N-Terminal PEGylation of Shk by Amide Formation. A 10 mg/mL solution of folded Shk (Peptide 5), in 100 mM Bicine pH 8.0, can be added to solid succinimidyl ester of 20 kDa PEG propionic acid (mPEG-SPA; CH$_3$O—[CH$_2$CH$_2$O]$_n$—CH$_2$CH$_2$CO—NHS) at room temperature using a 1.5 molar excess of the mPEG-SPA to Shk. After one hour with gentle stirring, the mixture can be diluted to 2 mg/mL with water, and the pH can be adjusted to 4.0 with dilute HCl. The extent of mono-pegylated Shk (Peptide 10), some di-PEGylated Shk or tri-PEGylated Shk, unmodified Shk and succinimidyl ester hydrolysis can be determined by SEC HPLC using a Superdex™ 75 HR 10/30 column (Amersham) eluted with 0.05 M NaH$_2$PO$_4$, 0.05 M Na$_2$HPO$_4$, 0.15 M NaCl, 0.01 M NaN$_3$, pH 6.8, at 1 mL/min. The fractions can be analyzed using a 4-20 tris-Gly SDS-PAGE gel and RP-HPLC. SDS-PAGE gels can be run for 1.5 hours at 125 V, 35 mA, 5 W. Pooled product can be then dialyzed at 4° C. in 3 changes of 1 L of A4S buffer (10 mM NaOAc, 5% sorbitol, pH 4.0). The dialyzed N-terminally PEGylated (amidated) ShK (Peptide 10) can be then concentrated in 10 K microCentrifuge filter to 2 mL volume and sterile-filtered using 0.2 μM syringe filter to give the final product.

in 5% $CO_2$ environment. Culture medium contains DMEM with GlutaMax™ (Invitrogen), 1× non-essential amino acid, 10% fetal bovine serum and 500 μg/mL geneticin. Cells were (Peptide 10, SEQ ID NO: 10)

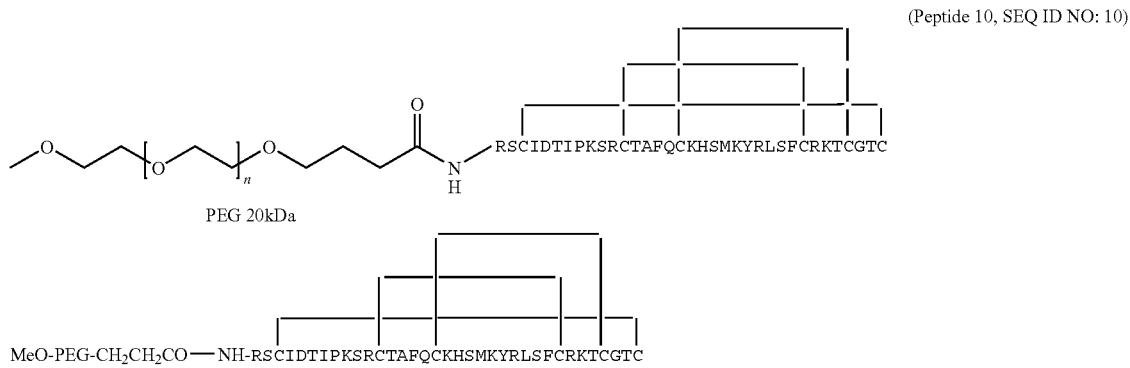

Example 35

Fc-L-SmIIIA

Fc-SmIIIA expression vector. A 104 bp BamHI-NotI fragment containing partial linker sequence and SmIIIA peptide encoded with human high frequency codons was assembled by PCR with overlapping primers 3654-50 and 3654-51 and cloned into to the 7.1 kb NotI-BamHI back bone to generate pcDNA3.1(+)CMVi-hFc-SmIIIA as described in Example 1.

plated and grown at low confluence on 35 mm culture dishes for at least 24 hours prior to electrophysiology experiments.

Electrophysiology Recording by Patch Clamping. Whole-cell currents were recorded from single cells by using tight seal configuration of the patch-clamp technique. A 35 mm culture dish was transferred to the recording stage after rinsing and replacing the culture medium with recording buffer containing 135 mM NaCl, 5 mM KCl, 1.8 mM $CaCl_2$, 10 mM HEPES, and 5 mM Glucose. pH was adjusted to 7.4 with NaOH and the osmolarity was set at 300 mOsm. Cells were

```
  BamHI
5'GGATCCGGAGGAGGAGGAAGCTGCTGCAACGGCCGCCGCGGCTGCAGCAGCCGCTGG     //SEQ ID NO: 872
                          C  C  N  G  R  R  G  C  S  S  R  W     SEQ ID NO: 873
TGCCGCGACCACAGCCGCTGCTGCTGAGCGGCCGC3'
C  R  D  H  S  R  C  C        NotI

Forward 5'-3'
GGAGGAGGATCCGGAGGAGGAGGAAGCTGCTGCAACGGCCGCCGCGGCTGCAGCAGC CGC   //SEQ ID NO: 874

Reverse 5'-3'
ATTATTGCGGCCGCTCAGCAGCAGCGGCTGTGGTCGCGGCACCAGCGGCTGCTGCAG CCGC SEQ ID NO: 875
```

The sequences of the BamHI to NotI fragments in the final constructs were verified by sequencing.

Transient expression of Fc-L-SmIIIa. 7.5 ug of the toxin peptide Fc fusion construct pcDNA3.1(+)CMVi-hFc-SmIIIA were transfected into 293-T cells in 10 cm tissue culture plate with FuGENE 6 as transfection reagent. Culture medium was replaced with serum-free medium at 24 hours post-transfection and the conditioned medium was harvested at day 5 post-transfection. Transient expression of Fc-SmIIIA from 293-T cells was analyzed by Western blot probed with anti-hFc antibody (FIG. 25A and FIG. 25B). Single band of expressed protein with estimated MW was shown in both reduced and non-reduced samples. Transient expression level of Fc-SmIIIA was further determined to be 73.4 μg/ml according to ELISA.

Example 36

Electrophysiology Experiments

Cell Culture. Stable cell line expressing human Kv1.3 channel was licensed from Biofocus. Cells were kept at 37° C.

perfused continuously with the recording buffer via one of the glass capillaries arranged in parallel and attached to a motorized rod, which places the glass capillary directly on top of the cell being recorded. Recording pipette solution contained 90 mM K-gluconate, 20 mM KF, 10 mM NaCl, 1 mM $MgCl_2$-$6H_2O$, 10 mM EGTA, 5 mM $K_2$-ATP, and 10 mM HEPES. The pH for the internal solution was adjusted to 7.4 with KOH and the osmolarity was set at 280 mOsm. Experiments were performed at room temperature (20-22° C.) and recorded using Multiclamp™ 700A amplifier (Molecular Devices Inc.). Pipette resistances were typically 2-3 MΩ.

Protein Toxin potency determination on Kv1.3 current: HEK293 cells stably expressing human Kv1.3 channel were voltage clamped at −80 mV holding potential. Outward Kv1.3 currents were activated by giving 200 msec long depolarizing steps to +30 mV from the holding potential of −80 mV and filtered at 3 kHz. Each depolarizing step was separated from the subsequent one with a 10 s interval. Analogue signals were digitized by Digidata™ 1322A digitizer (Molecular Devices) and subsequently stored on computer disk for offline analyses using Clampfit™ 9 (Molecular Devices Inc.). In all studies, stable baseline Kv1.3 current amplitudes were established for 4 minutes before starting the perfusion of the protein toxin at incremental concentrations. A steady state block was always achieved before starting the perfusion of the subsequent concentration of the protein toxin.

Data analysis. Percent of control (POC) is calculated based on the following equation: (Kv1.3 current after protein toxin addition/Kv1.3 current in control)*100. At least 5 concentrations of the protein toxin (e.g. 0.003, 0.01, 0.03, 0.1, 0.3, 100 nM) were used to calculate the $IC_{50}$ value. $IC_{50}$ values and curve fits were estimated using the four parameter logistic fit of XLfit software (Microsoft Corp.). $IC_{50}$ values are presented as mean value±s.e.m. (standard error of the mean).

Drug preparations. Protein toxins (typically 10-100 μM) were dissolved in distilled water and kept frozen at −80° C. Serial dilutions of the stock protein toxins were mixed into the recording buffer containing 0.1% bovine serum albumin (BSA) and subsequently transferred to glass perfusion reservoirs. Electronic pinch valves controlled the flow of the protein toxin from the reservoirs onto the cell being recorded.

Example 37

Immunobiology and Channel Binding

Inhibition of T cell cytokine production following PMA and anti-CD3 antibody stimulation of PBMCs. PBMC's were previously isolated from normal human donor Leukophoresis packs, purified by density gradient centrifugation (Ficoll Hypaque), cryopreserved in CPZ Cryopreservation Medium Complete (INCELL, MCPZF-100 plus 10% DMSO final). PBMC's were thawed (95% viability), washed, and seeded at $2\times10^5$ cells per well in culture medium (RPMI medium 1640; GIBCO) supplemented with 10% fetal calf serum, 100 U/ml penicillin, 100 mg/ml streptomycin 2 mM L-glutamine, 100 uM non-essential amino acids, and 20 uM 2-ME) in 96-well flat-bottom tissue culture plates. Cells were pre-incubated with serially diluted (100 nM-0.001 nM final) ShK[1-35], Fc-L10-ShK[1-35] or fc control for 90 min before stimulating for 48 hr with PMA/anti-CD3 (1 ng/ml and 50 ng/ml, respectively) in a final assay volume of 200 ul. Analysis of the assay samples was performed using the Meso Scale Discovery (MSD) SECTOR™ Imager 6000 (Meso Scale Discovery, Gaithersbury, Md.) to measure the IL-2 and IFNg protein levels by utilizing electrochemiluminescence (ECL). The conditioned medium (50 ul) was added to the MSD Multi-spot 96-well plates (each well containing three capture antibodies; IL-2, TNF, IFNγ). The plates were sealed, wrapped in tin foil, and incubated at room temperature on a plate shaker for 2 hr. The wells were washed 1× with 200 ul PBST (BIOTEK, Elx405 Auto Plate Washer). For each well, 20 ul of Ruthenium-labeled detection antibodies (1 ug/ml final in Antibody Dilution Buffer; IL-1, TNF, IFNγ) and 130 ul of 2×MSD Read Buffer added, final volume 150 ul. The plates were sealed, wrapped in tin foil, and incubated at room temperature on a plate shaker for 1 hr. The plates were then read on the SECTOR™ Imager 6000. FIGS. 35A & 35B shows the CHO-derived Fc-L10-ShK[1-35] peptibody potently inhibits IL-2 and IFNg production from T cells in a dose-dependent manner. Compared to native ShK[1-35] peptide, the peptibody produces a greater extent of inhibition (POC=Percent Of Control of response in the absence of inhibitor).

Inhibition of T cell cytokine production following Anti-CD3 and anti-CD28 antibody stimulation of PBMCs. PBMCs were previously isolated from normal human donor Leukopheresis packs, purified by density gradient centrifugation (Ficoll Hypaque), and cryopreserved using INCELL Freezing Medium. PBMCs were thawed (95% viability), washed, and seeded (in RPMI complete medium containing serum replacement, PSG) at $2\times10^5$ cells per well into 96-well flat bottom plates. Cells were pre-incubated with serially diluted (100 nM-0.003 nM final) ShK[1-35], Fc-L10-ShK[1-35], or Fc control for 1 hour before the addition of aCD3 and aCD28 (2.5 ng/mL and 100 ng/mL respectively) in a final assay volume of 200 mL. Supernatants were collected after 48 hours, and analyzed using the Meso Scale Discovery (MSD) SECTOR™ Imager 6000 (Meso Scale Discovery, Gaithersbury, Md.) to measure the IL-2 and IFNg protein levels by utilizing electrochemiluminescence (ECL). 20 mL of supernatant was added to the MSD multi-spot 96-well plates (each well containing IL-2, TNFa, and IFNg capture antibodies). The plates were sealed and incubated at room temperature on a plate shaker for 1 hour. Then 20 mL of Ruthenium-labeled detection antibodies (1 ug/ml final of IL-2, TNFα, and IFNγ in Antibody Dilution Buffer) and 110 mL of 2×MSD Read Buffer were added. The plates were sealed, covered with tin foil, and incubated at room temperature on a plate shaker for 1 hour. The plates were then read on the SECTOR™ Imager 6000. FIGS. 37A & 37B shows the CHO-derived Fc-L10-ShK[1-35] peptibody potently inhibits IL-2 and IFNg production from T cells in a dose-dependent manner. Compared to native ShK[1-35] peptide which shows only partial inhibtion, the peptibody produces nearly complete inhibitiono of the inflammatory cytokine response. (POC=Percent Of Control of response in the absence of inhibitor).

Inhibition of T cell proliferation following anti-CD3 and anti-CD28 antibody stimulation of PBMCs. PBMC's were previously isolated from normal human donor Leukophoresis packs, purified by density gradient centrifugation (Ficoll Hypaque), cryopreserved in CPZ Cryopreservation Medium Complete (INCELL, MCPZF-100 plus 10% DMSO final). PBMC's were thawed (95% viability), washed, and seeded at $2\times10^5$ cells per well in culture medium (RPMI medium 1640; GIBCO) supplemented with 10% fetal calf serum, 100 U/ml penicillin, 100 mg/ml streptomycin, 2 mM L-glutamine, 100 μM non-essential amino acids, and 20 μM 2-ME) in 96-well flat-bottom tissue culture plates. Cells were pre-incubated with either anti-human CD32 (FcγRII) blocking antibody (per manufacturers instructions EASY SEP Human Biotin Selection Kit #18553, StemCell Technologies Vancouver, BC) or Fc-L10-ShK (100 nM-0.001 nM final) for 45 min. Fc-L10-ShK (100 nM-0.001 nM final) was then added to the cells containing anti-human CD32 blocking antibody while medium was added to the cells containing Fc-L10-ShK. Both sets were incubated for an additional 45 min before stimulating for 48 hr with aCD3/aCD28 (0.2 ng/ml and 100 ng/ml, respectively). Final assay volume was 200 ul. [3H]TdR (1 uCi per well) was added and the plates were incubated for an additional 16 hrs. Cells were then harvested onto glass fiber filters and radioactivity was measured in a B-scintillation counter. FIGS. 36A & 36B shows the CHO-derived Fc-L10-ShK[1-35] peptibody potently inhibits proliferation of T cells in a dose-dependent manner. Pre-blocking with the anti-CD32 (FcR) blocking antibody has little effect on the peptibodies ability to inhibit T cell proliferation suggesting Kv1.3 inhibition and not FcR binding is the mechanism for the inhibition observed (POC=Percent Of Control of response in the absence of inhibitor).

Immunohistochemistry analysis of Fc-L10-ShK[1-35] binding to HEK 293 cells overexpressing human Kv1.3. HEK 293 cells overexpressing human Kv1.3 (HEK Kv1.3) were obtained from BioFocus plc (Cambridge, UK) and maintained per manufacturer's recommendation. The parental HEK 293 cell line was used as a control. Cells were plated on Poly-D-Lysine 24 well plates (#35-4414; Becton-Dickinson, Bedford, Mass.) and allowed to grow to approximately 70% confluence. HEK KV1.3 were plated at 0.5×10e5 cells/well in 1 ml/well of medium. HEK 293 cells were plated at a density of 1.5×10e5 cells/well in 1 ml/well of medium. Before staining, cells were fixed with formalin (Sigma HT50-1-1 Formalin solution, diluted 1:1 with PBS/0.5% BSA before use) by removing cell growth medium, adding 0.2 ml/well formalin solution and incubating at room temperature for ten minutes. Cells were stained by incubating with 0.2 ml/well of 5 ug/ml Fc-L10-ShK[1-35] in PBS/BSA for 30' at room temperature. Fc-L10-ShK[1-35] was aspirated and then the cells were washed one time with PBS/0.5% BSA. Detection antibody (Goat F(ab)2 anti-human IgG-phycoerythrin; Southern Biotech Associates, Birmingham, Ala.) was added to the wells at 5 ug/ml in PBS/0.5% BSA and incubated for 30' at room temperature. Wash cells once with PBS/0.5% BSA and examine using confocal microscopy (LSM 510 Meta Confocal Microscope; Carl Zeiss AG, Germany). FIG. 33B shows the Fc-L10-ShK[1-35] peptibody retains binds to Kv1.3 overexpressing HEK 293 cells but shows little binding to untransfected cells (FIG. 33A) indicating the Fc-L10-ShK[1-35] peptibody can be used as a reagent to detect cells overexpressing the Kv1.3 channel. In disease settings where activated T effector memory cells have been reported to overproduce Kv1.3, this reagent can find utility in both targeting these cells and in their detection.

An ELISA assay demonstrating Fc-L10-ShK[1-35] binding to fixed HEK 293 cells overexpressing Kv1.3. FIG. 34A shows a dose-dependent increase in the peptibody binding to fixed cells that overexpress Kv1.3, demonstrating that the peptibody shows high affinity binding to its target and the utility of the Fc-L10-ShK[1-35] molecule in detection of cells expressing the channel. Antigen specific T cells that cause disease in patients with multiple sclerosis have been shown to overexpress Kv1.3 by whole cell patch clamp electrophysiology,—a laborius approach. Our peptibody reagent can be a useful and convenient tool for monitoring Kv1.3 channel expression in patients and have utility in diagnostic applications. The procedure shown in FIG. 34A and FIG. 34B follows.

FIG. 34A. A whole cell immunoassay was performed to show binding of intact Fc-L10-ShK[1-35] to Kv1.3 transfected HEK 293 cells (BioFocus plc, Cambridge, UK). Parent HEK 293 cells or HEK Kv1.3 cells were plated at 3×10e4 cells/well in poly-D-Lysine coated ninety-six well plates (#35-4461; Becton-Dickinson, Bedford, Mass.). Cells were fixed with formalin (Sigma HT50-1-1 Formalin solution, diluted 1:1 with PBS/0.5% BSA before use) by removing cell growth medium, adding 0.2 ml/well formalin solution and incubating at room temperature for 25 minutes and then washing one time with 100 ul/well of PBS/0.5% BSA. Wells were blocked by addition of 0.3 ml/well of BSA blocker (50-61-00; KPL 10% BSA Diluent/Blocking Solution, diluted 1:1 with PBS; KPL, Gaithersburg, Md.) followed by incubation at room temperature, with shaking, for 3 hr. Plates were washed 2 times with 1×KP Wash Buffer (50-63-00; KPL). Samples were diluted in Dilution Buffer (PBS/0.5% Tween-20) or Dilution Buffer with 1% Male Lewis Rat Serum (RATSRM-M; Bioreclamation Inc., Hicksville, N.Y.) and 0.1 ml/well was added to blocked plates, incubating for 1 hr at room temperature with shaking. Plates were washed 3 times with 1×KP Wash Buffer and then incubated with HRP-Goat anti-human IgG Fc (#31416; Pierce, Rockford, Ill.) diluted 1:5000 in PBS/0.1% Tween-20 for 1 hr at room temperature, with shaking. Plates were washed plates 3 30 times with 1×KP Wash Buffer, and then 0.1 ml/well TMB substrate (52-00-01; KPL) was added. The reactions were stopped by addition of 0.1 ml/well 2 N Sulfuric Acid. Absorbance was read at 450 nm on a Molecular Devices SpectroMax 340 (Sunnyvale, Calif.).

FIG. 34B. Whole cell immunoassay was performed as above with the following modifications. HEK 293 cells were plated at 1×10e5 cells/well and HEK Kv1.3 cells were plated at 6×10e4 cells/well in poly-D-Lysine coated 96 well plates. Fc Control was added at 500 ng/ml in a volume of 0.05 ml/well. HRP-Goat anti-human IgG Fc (#31416; Pierce, Rockford, Ill.) was diluted 1:10,000 in PBS/0.1% Tween-20. ABTS (50-66-00, KPL) was used as the substrate. Absorbances were read at 405 nm after stopping reactions by addition of 0.1 ml/well of 1% SDS.

Example 38

Purification of Fc-L10-ShK(1-35)

Expression of Fc-L10-ShK[1-35] was as described in Example 3 herein above. Frozen, *E. coli* paste (18 g) was combined with 200 ml of room temperature 50 mM tris HCl, 5 mM EDTA, pH 8.0 and was brought to about 0.1 mg/ml hen egg white lysozyme. The suspended paste was passed through a chilled microfluidizer twice at 12,000 PSI. The cell lysate was then centrifuged at 22,000 g for 15 min at 4° C. The pellet was then resuspended in 200 ml 1% deoxycholic acid using a tissue grinder and then centrifuged at 22,000 g for 15 min at 4° C. The pellet was then resuspended in 200 ml water using a tissue grinder and then centrifuged at 22,000 g for 15 min at 4° C. The pellet (3.2 g) was then dissolved in 32 ml 8 M guanidine HCl, 50 mM tris HCl, pH 8.0. The pellet solution was then centrifuged at 27,000 g for 15 min at room temperature, and then 5 ml of the supernatant was transferred to 500 ml of the refolding buffer (3 M urea, 20% glycerol, 50 mM tris, 160 mM arginine HCl, 5 mM EDTA, 1 mM cystamine HCl, 4 mM cysteine, pH 9.5) at 4° C. with vigorous stirring. The stirring rate was then slowed and the incubation was continued for 2 days at 4° C. The refolding solution was then stored at −70° C.

The stored refold was defrosted and then diluted with 2 L of water and the pH was adjusted to 7.3 using 1 M $H_3PO_4$. The pH adjusted material was then filtered through a 0.22 µm cellulose acetate filter and loaded on to a 60 ml Amersham SP-FF (2.6 cm I.D.) column at 20 ml/min in S-Buffer A (20 mM NaH2PO4, pH 7.3) at 7° C. The column was then washed with several column volumes of S-Buffer A, followed by elution with a linear gradient from 0% to 60% S-Buffer B (20 mM NaH2PO4, 1 M NaCl, pH 7.3) followed by a step to 100% S-Buffer B at 10 ml/min 7° C. Fractions were then analyzed using a Coomassie brilliant blue stained tris-glycine 4-20% SDS-PAGE, and the fractions containing the desired product were pooled based on these data. The pool was then loaded on to a 1 ml Amersham rProtein A HiTrap column in PBS at 1 ml/min 7° C. Then column was then washed with several column volumes of 20 mM $NaH_2PO_4$ pH 6.5, 1 M NaCl and eluted with 100 mM glycine pH 3.0. To the elution peak, 0.0125 volumes (25 ml) of 3 M sodium acetate was added.

A spectral scan was then conducted on 50 µl of the combined pool diluted in 700 µl water using a Hewlett Packard 8453 spectrophotometer (FIG. 46A). The concentration of the filtered material was determined to be 2.56 mg/ml using a calculated molecular mass of 30,410 g/mol and extinction coefficient of 36,900 $M^{-1}$ $cm^{-1}$. The purity of the filtered material was then assessed using a Coomassie brilliant blue stained tris-glycine 4-20% SDS-PAGE (FIG. 46B). The macromolecular state of the product was then determined using size exclusion chromatography on 20 µg of the product injected on to a Phenomenex BioSep SEC 3000 column (7.8× 300 mm) in 50 mM NaH$_2$PO$_4$, 250 mM NaCl, pH 6.9 at 1 ml/min observing the absorbance at 280 nm (FIG. 46C). The product was then subject to mass spectral analysis by diluting 1 µl of the sample into 10 µl of sinapinic acid (10 mg per ml in 0.05% trifluroacetic acid, 50% acetonitrile). One milliliter of the resultant solution was spotted onto a MALDI sample plate. The sample was allowed to dry before being analyzed using a Voyager DE-RP time-of-flight mass spectrometer equipped with a nitrogen laser (337 nm, 3 ns pulse). The positive ion/linear mode was used, with an accelerating voltage of 25 kV. Each spectrum was produced by accumulating data from ~200 laser shots. External mass calibration was accomplished using purified proteins of known molecular masses. The product was then stored at −80° C.

The IC$_{50}$ for blockade of human Kv1.3 by purified *E. coli*-derived Fc-L10-ShK[1-35], also referred to as "Fc-L-ShK[1-35]", is shown in Table 35 (in Example 50 herein below).

Example 39

Purification of Bacterially Expressed Fc-L10-ShK(2-35)

Expression of Fc-L10-ShK[2-35] was as described in Example 4 herein above. Frozen, *E. coli* paste (16.5 g) was combined with 200 ml of room temperature 50 mM tris HCl, 5 mM EDTA, pH 8.0 and was brought to about 0.1 mg/ml hen egg white lysozyme. The suspended paste was passed through a chilled microfluidizer twice at 12,000 PSI. The cell lysate was then centrifuged at 22,000 g for 15 min at 4° C. The pellet was then resuspended in 200 ml 1% deoxycholic acid using a tissue grinder and then centrifuged at 22,000 g for 15 min at 4° C. The pellet was then resuspended in 200 ml water using a tissue grinder and then centrifuged at 22,000 g for 15 min at 4° C. The pellet (3.9 g) was then dissolved in 39 ml 8 M guanidine HCl, 50 mM tris HCl, pH 8.0. The pellet solution was then centrifuged at 27,000 g for 15 min at room temperature, and then 5 ml of the supernatant was transferred to 500 ml of the refolding buffer (3 M urea, 20% glycerol, 50 mM tris, 160 mM arginine HCl, 5 mM EDTA, 1 mM cystamine HCl, 4 mM cysteine, pH 9.5) at 4° C. with vigorous stirring. The stirring rate was then slowed and the incubation was continued for 2 days at 4° C. The refolding solution was then stored at −70° C.

The stored refold was defrosted and then diluted with 2 L of water and the pH was adjusted to 7.3 using 1 M H$_3$PO$_4$. The pH adjusted material was then filtered through a 0.22 µm cellulose acetate filter and loaded on to a 60 ml Amersham SP-FF (2.6 cm I.D.) column at 20 ml/min in S-Buffer A (20 mM NaH$_2$PO$_4$, pH 7.3) at 7° C. The column was then washed with several column volumes of S-Buffer A, followed by elution with a linear gradient from 0% to 60% S-Buffer B (20 mM NaH2PO4, 1 M NaCl, pH 7.3) followed by a step to 100% S-Buffer B at 10 ml/min 7° C. The fractions containing the desired product were pooled and filtered through a 0.22 µm cellulose acetate filter. The pool was then loaded on to a 1 ml Amersham rProtein A HiTrap column in PBS at 2 ml/min 7° C. Then column was then washed with several column volumes of 20 mM NaH$_2$PO$_4$ pH 6.5, 1 M NaCl and eluted with 100 mM glycine pH 3.0. To the elution peak, 0.0125 volumes (18 ml) of 3 M sodium acetate was added, and the sample was filtered through a 0.22 µm cellulose acetate filter.

A spectral scan was then conducted on 20 µl of the combined pool diluted in 700 µl water using a Hewlett Packard 8453 spectrophotometer (FIG. 40A). The concentration of the filtered material was determined to be 3.20 mg/ml using a calculated molecular mass of 29,282 g/mol and extinction coefficient of 36,900 M$^{-1}$ cm$^{-1}$. The purity of the filtered material was then assessed using a Coomassie brilliant blue stained tris-glycine 4-20% SDS-PAGE (FIG. 40B). The macromolecular state of the product was then determined using size exclusion chromatography on 50 µg of the product injected on to a Phenomenex BioSep SEC 3000 column (7.8× 300 mm) in 50 mM NaH$_2$PO$_4$, 250 mM NaCl, pH 6.9 at 1 ml/min observing the absorbance at 280 nm (FIG. 40C). The product was then subject to mass spectral analysis by diluting 1 µl of the sample into 10 µl of sinapinic acid (10 mg per ml in 0.05% trifluroacetic acid, 50% acetonitrile). One milliliter of the resultant solution was spotted onto a MALDI sample plate. The sample was allowed to dry before being analyzed using a Voyager DE-RP time-of-flight mass spectrometer equipped with a nitrogen laser (337 nm, 3 ns pulse). The positive ion/linear mode was used, with an accelerating voltage of 25 kV. Each spectrum was produced by accumulating data from ~200 laser shots. External mass calibration was accomplished using purified proteins of known molecular masses (FIG. 40D). The product was then stored at −80° C.

The IC$_{50}$ for blockade of human Kv1.3 by purified *E. coli*-derived Fc-L10-ShK[2-35], also referred to as "Fc-L-ShK[2-35]", is shown in Table 35 (in Example 50 herein below).

Example 40

Purification of Bacterially Expressed Fc-L10-OsK1

Frozen, *E. coli* paste (129 g; see Example 10) was combined with 1290 ml of room temperature 50 mM tris HCl, 5 mM EDTA, pH 7.8 and was brought to about 0.1 mg/ml hen egg white lysozyme. The suspended paste was passed through a chilled microfluidizer twice at 12,000 psi. The cell lysate was then centrifuged at 17,700 g for 15 min at 4° C. The pellet was then resuspended in 1290 ml 1% deoxycholic acid using a tissue grinder and then centrifuged at 17,700 g for 15 min at 4° C. The pellet was then resuspended in 1290 ml water using a tissue grinder and then centrifuged at 17,700 g for 15 min at 4° C. 8 g of the pellet (16.3 g total) was then dissolved in 160 ml 8 M guanidine HCl, 50 mM tris HCl, pH 8.0. 100 ml of the pellet solution was then incubated with 1 ml of 1 M DTT for 60 min at 37° C. The reduced material was transferred to 5000 ml of the refolding buffer (1 M urea, 50 mM tris, 160 mM arginine HCl, 2.5 mM EDTA, 1.2 mM cystamine HCl, 4 mM cysteine, pH 10.5) at 2 ml/min, 4° C. with vigorous stirring. The stirring rate was then slowed and the incubation was continued for 3 days at 4° C.

The pH of the refold was adjusted to 8.0 using acetic acid. The pH adjusted material was then filtered through a 0.22 µm cellulose acetate filter and loaded on to a 50 ml Amersham Q Sepharose-FF (2.6 cm I.D.) column at 10 ml/min in Q-Buffer A (20 mM Tris, pH 8.5) at 8° C. with an inline 50 Amersham Protein A column (2.6 cm I.D.). After loading, the Q Sepharose column was removed from the circuit, and the remaining chromatography was carried out on the protein A column. The column was washed with several column volumes of Q-Buffer A, followed by elution using a step to 100 mM glycine pH 3.0. The fractions containing the desired product were pooled and immediately loaded on to a 50 ml Amersham SP-Sepharose HP column (2.6 cm I.D.) at 20 ml/min in S-Buffer A (20 mM NaH$_2$PO$_4$, pH 7.0) at 8° C. The column was then washed with several column volumes of S-Buffer A followed by a linear gradient from 5% to 60% S-Buffer B (20 mM NaH$_2$PO$_4$, 1 M NaCl, pH 7.0) followed by a step to 100% S-Buffer B. Fractions were then analyzed using a Coomassie brilliant blue stained tris-glycine 4-20% SDS-PAGE. The fractions containing the bulk of the desired product were pooled and then applied to a 75 ml MEP Hypercel column (2.6 cm I.D.) at 5 ml/min in MEP Buffer A (20 mM tris, 200 mM NaCl, pH 8.0) at 8° C. Column was eluted with a linear gradient from 5% to 50% MEP Buffer B (50 mM sodium citrate pH 4.0) followed by a step to 100% MEP Buffer B. Fractions were then analyzed using a Coomassie brilliant blue stained tris-glycine 4-20% SDS-PAGE, and the fractions containing the bulk of the desired product were pooled.

The MEP pool was then concentrated to about 20 ml using a Pall Jumbo-Sep with a 10 kDa membrane followed by buffer exchange with Formulation Buffer (20 mM NaH$_2$PO$_4$, 200 mM NaCl, pH 7.0) using the same membrane. A spectral scan was then conducted on 50 µl of the combined pool diluted in 700 µl Formulation Buffer using a Hewlett Packard 8453 spectrophotometer (FIG. 41A). The concentration of the material was determined to be 4.12 mg/ml using a calculated molecular mass of 30,558 g/mol and extinction coefficient of 35,720 M$^{-1}$ cm$^{-1}$. The purity of the material was then assessed using a Coomassie brilliant blue stained tris-glycine 4-20% SDS-PAGE (FIG. 41B). The macromolecular state of the product was then determined using size exclusion chromatography on 123 µg of the product injected on to a Phenomenex BioSep SEC 3000 column (7.8×300 mm) in 50 mM NaH$_2$PO$_4$, 250 mM NaCl, pH 6.9 at 1 ml/min observing the absorbance at 280 nm (FIG. 41C). The product was then subject to mass spectral analysis by chromatographing approximately 4 µg of the sample through a RP-HPLC column (Vydac C$_4$, 1×150 mm). Solvent A was 0.1% trifluoroacetic acid in water and solvent B was 0.1% trifluoroacetic acid in 90% acetonitrile, 10% water. The column was pre-equilibrated in 10% solvent B at a flow rate of 80 µl per min. The protein was eluted using a linear gradient of 10% to 90% solvent B over 30 min. Part of the effluent was directed into a LCQ ion trap mass spectrometer. The mass spectrum was deconvoluted using the Bioworks software provided by the mass spectrometer manufacturer. (FIG. 41D). The product was filtered through a 0.22 µm cellulose acetate filter and then stored at −80° C.

The yield for the *E. coli*-expressed Fc-L10-OSK1 prep was 81 mg from 40 g of cell paste (129 g×(8 g/16.3 g)×(100 ml/160 ml)=39.6 g which was rounded to 40 g), the purity was greater than 80% judging by SDS-PAGE, it is running as the expected dimer judging by SEC-HPLC, and the mass was within the expected molecular weight range judging by MS.

The IC$_{50}$ for blockade of human Kv1.3 by purified *E. coli*-derived Fc-L10-OSK1, also referred to as "Fc-L-OSK1", is shown in Table 35 (in Example 50 herein below).

Example 41

Fc-L10-OSK1, Fc-L10-OSK1 [K7S], Fc-L10-OSK1 [E16K,K20D], and Fc-L10-OSK1 [K7S,E16K,K20D] Expressed by Mammalian Cells Fc-L10-OSK1, Fc-L10-OSK1 [K7S], Fc-L10-OSK1 [E16K,K20D], and Fc-L10-OSK1 [K7S,E16K,K20D], inhibitors of Kv1.3, were expressed in mammalian cells. A DNA sequence coding for the Fc region of human IgG1 fused in-frame to a linker sequence and a monomer of the Kv1.3 inhibitor peptide OSK1, OSK1 [K7S], OSK1 [E16K,K20D], or OSK1 [K7S,E16K,K20D] was constructed as described below. Methods for expressing and purifying the peptibody from mammalian cells (HEK 293 and Chinese Hamster Ovary cells) are disclosed herein.

For construction of Fc-L10-OSK1, Fc-L10-OSK1 [K7S], Fc-L10-OSK1 [E16K,K20D], and Fc-L10-OSK1 [K7S, E16K,K20D] expression vectors, a PCR strategy was employed to generate the full length genes, OSK1, OSK1 [K7S], OSK1 [E16K,K20D], and OSK1 [K7S,E16K,K20D], each linked to a four glycine and one serine amino acid linker with two stop codons and flanked by BamHI and NotI restriction sites as shown below.

Two oligos for each of OSK1, OSK1 [K7S], OSK1 [E16K, K20D], and [K7S,E16K,K20D]OSK1 with the sequence as depicted below were used in a PCR reaction with Pfu Turbo HotStart DNA polymerase (Stratagene) at 95° C.-30 sec, 55° C.-30 sec, 75° C.-45 sec for 35 cycles; BamHI (ggatcc) and NotI (gcggccgc) restriction sites are underlined.

```
OSK1:
Forward primer:
cat gga tcc gga gga gga gga agc         (SEQ ID NO: 876)
ggc gtg atc atc aac gtg aag tgc
aag atc agc cgc cag tgc ctg gag
ccc tgc aag aag gcc g;

Reverse primer:
cat gcg gcc gct tac tac ttg ggg         (SEQ ID NO: 877)
gtg cag tgg cac ttg ccg ttc atg
cac ttg ccg aag cgc atg ccg gcc
ttc ttg cag ggc tcc a;

OSK1[K7S]:
Forward primer:
cat gga tcc gga gga gga gga agc         (SEQ ID NO: 878)
ggc gtg atc atc aac gtg agc tgc
aag atc agc cgc cag tgc ctg gag
ccc tgc aag aag gcc g;

Reverse primer:
cat gcg gcc gct tac tac ttg ggg         (SEQ ID NO: 879)
gtg cag tgg cac ttg ccg ttc atg
cac ttg ccg aag cgc atg ccg gcc
ttc ttg cag ggc tcc a;

OSK1[E16K, K20D]:
Forward primer:
cat gga tcc gga gga gga gga agc         (SEQ ID NO: 880)
ggc gtg atc atc aac gtg aag tgc
aag atc agc cgc cag tgc ctg aag
ccc tgc aag gac gcc g;

Reverse primer:
cat gcg gcc gct tac tac ttg ggg         (SEQ ID NO: 881)
gtg cag tgg cac ttg ccg ttc atg
cac ttg ccg aag cgc atg ccg gcg
tcc ttg cag ggc ttc a;

OSK1[K7S, E16K, K20D]:
Forward primer:
cat gga tcc gga gga gga gga agc         (SEQ ID NO: 882)
ggc gtg atc atc aac gtg agc tgc
aag atc agc cgc cag tgc ctg aag
ccc tgc aag gac gcc g;

Reverse primer:
cat gcg gcc gct tac tac ttg ggg         (SEQ ID NO: 883)
gtg cag tgg cac ttg ccg ttc atg
cac ttg ccg aag cgc atg ccg gcg
tcc ttg cag ggc ttc a.
```

The resulting PCR products were resolved as the 155 bp bands on a four percent agarose gel. The 155 bp PCR product was purified using PCR Purification Kit (Qiagen), then digested with BamHI and NotI (Roche) restriction enzymes, and agarose gel was purified by Gel Extraction Kit (Qiagen).

At the same time, the pcDNA3.1 (+)CMVi-hFc-Shk[2-35] vector was digested with BamHI and NotI restriction enzymes and the large fragment was purified by Gel Extraction Kit. The gel purified PCR fragment was ligated to the purified large fragment and transformed into One Shot® Top 10F' (Invitrogen). DNAs from transformed bacterial colonies were isolated and digested with BamHI and NotI restriction enzymes and resolved on a two percent agarose gel. DNAs resulting in an expected pattern were submitted for sequencing. Although, analysis of several sequences of clones yielded a 100% percent match with the above sequences, only one clone from each gene was selected for large scaled plasmid purification. The DNA of Fc-L10-OSK1, Fc-L10-OSK1 [K7S], Fc-L10-OSK1[E16K,K20D], and Fc-L10-OSK1 [K7S,E16K,K20D] in pCMVi vector was resequenced to confirm the Fc and linker regions and the sequence was 100% identical to the above sequences. The sequences and pictorial representations of Fc-L10-OSK1, Fc-L10-OSK1[K7S], Fc-L10-OSK1[E16K,K20D], and Fc-L10-OSK1[K7S, E16K,K20D] are depicted in FIG. 42A-B, FIG. 43A-B, FIG. 44A-B and FIG. 45A-B, respectively.

HEK-293 cells used in transient transfection expression of Fc-L10-OSK1, Fc-L10-OSK1[K7S], Fc-L10-OSK1[E16K, K20D], and Fc-L10-OSK1[K7S,E16K,K20D] in pCMVi protein were cultured in growth medium containing DMEM High Glucose (Gibco), 10% fetal bovine serum (FBS from Gibco), 1× non-essential amino acid (NEAA from Gibco) and 1× Penicillin/Streptomycine/Glutamine (Pen/Strep/Glu from Gibco). 5.6 µg each of Fc-L10-OSK1, Fc-L10-OSK1[K7S], Fc-L10-OSK1[E16K,K20D], and Fc-L10-OSK1[K7S, E16K,K20D] in pCMVi plasmid that had been phenol/chloroform extracted was transfected into HEK-293 cells using FuGENE 6 (Roche). The cells were recovered for 24 hours, and then placed in DMEM High Glucose, 1×NEAA and 1× Pen/Strep/Glu medium for 48 hours. Fc-L10-OSK1[K7S], Fc-L10-OSK1[E16K,K20D], and Fc-L10-OSK1[K7S, E16K,K20D] were purified from medium conditioned by these transfected HEK-293 cells using a protocol described in Example 50 herein below.

Fifteen µl of conditioned medium was mixed with an in-house 4× Loading Buffer (without β-mercaptoethanol) and electrophoresed on a Novex 4-20% tris-glycine gel using a Novex Xcell II apparatus at 101V/46 mA for 2 hours in a 1× Gel Running solution (25 mM Tris Base, 192 mM Glycine, 3.5 mM SDS) along with 20 µl of BenchMark Pre-Stained Protein ladder (Invitrogen). The gel was then soaked in Electroblot buffer (25 mM Tris base, 192 mM glycine, 20% methanol,) for 5 minutes. A nitrocellulose membrane from Invitrogen (Cat. No. LC200, 0.2 µm pores size) was soaked in Electroblot buffer. The pre-soaked gel was blotted to the nitrocellulose membrane using the Mini Trans-Blot Cell module according to the manufacturer instructions (Bio-Rad Laboratories) at 300 mA for 2 hours. The blot was rinsed in Tris buffered saline solution pH 7.5 with 0.1% Tween20 (TBST). Then, the blot was first soaked in a 5% milk (Carnation) in TBST for 1 hour at room temperature, followed by washing three times in TBST for 10 minutes per wash. Then, incubated with 1:1000 dilution of the HRP-conjugated Goat anti-human IgG, (Fcγ) antibody (Pierece Biotechnology Cat. no. 31413) in TBST with 5% milk buffer for 1 hour with shaking at room temperature. The blot was then washed three times in TBST for 15 minutes per wash at room temperature. The primary antibody was detected using Amersham Pharmacia Biotech's ECL western blotting detection reagents according to manufacturer's instructions. Upon ECL detection, the western blot analysis displayed the expected size of 66 kDa under non-reducing gel conditions (FIG. 46).

Plasmids containing the Fc-L10-OSK1, Fc-L10-OSK1 [K7S], Fc-L10-OSK1[E16K,K20D], and Fc-L10-OSK1 [K7S,E16K,K20D] inserts in pCMVi vector were digested with XbaI and NotI (Roche) restriction enzymes and gel purified. The inserts were individually ligated into SpeI and NotI (Roche) digested pDSRα24 (Amgen Proprietary) expression vector. Integrity of the resulting constructs were confirmed by DNA sequencing. Although, analysis of several sequences of clones yielded a 100% percent match with the above sequence, only one clone was selected for large scaled plasmid purification.

AM1 CHOd-(Amgen Proprietary) cells used in the stable expression of Fc-L10-OSK1 protein were cultured in AM1 CHOd-growth medium containing DMEM High Glucose, 10% fetal bovine serum, 1x hypoxantine/thymidine (HT from Gibco), 1×NEAA and 1× Pen/Strep/Glu. 5.6 µg of pDSRα-24-Fc-L10-OSK1 plasmid was transfected into AM1 CHOd-cells using FuGene 6. Twenty-four hours post transfection, the cells were split 1:11 into DHFR selection medium (DMEM High Glucose plus 10% Dialyzed Fetal Bovine Serum (dFBS), 1×NEAA and 1× Pen/Strep/Glu) and at 1:50 dilution for colony selection. The cells were selected in DHFR selection medium for thirteen days. The ten 10-cm² pools of the resulting colonies were expanded to ten T-175 flasks, then were scaled up ten roller bottles and cultured under AM1 CHOd-production medium (DMEM/F12 (1:1), 1×NEAA, 1× Sodium Pyruvate (Na Pyruvate), 1× Pen/Strep/Glu and 1.5% DMSO). The conditioned medium was harvested and replaced at one-week intervals. The resulting six liters of conditioned medium were filtered through a 0.45 µm cellulose acetate filter (Corning, Acton, Mass.), and characterized by SDS-PAGE analysis as shown in FIG. 47. Then, transferred to Protein Chemistry for purification.

Twelve colonies were selected after 13 days on DHFR selection medium and picked into one 24-well plate. The plate was allowed to grow up for one week, and then was transferred to AM1 CHOd-production medium for 48-72 hours and the conditioned medium was harvested. The expression levels were evaluated by Western blotting similar to the transient Western blot analysis with detection by the same HRP-conjugated Goat anti-human IgG, (Fcγ) antibody to screen 5 µl of conditioned medium. All 12 stable clones exhibited expression at the expected size of 66 kDa. Two clones, A3 and C2 were selected and expanded to T175 flask for freezing with A3 as a backup to the primary clone C2 (FIG. 48).

The C2 clone was scaled up into fifty roller bottles (Corning) using selection medium and grown to confluency. Then, the medium was exchanged with a production medium, and let incubate for one week. The conditioned medium was harvested and replaced at the one-week interval. The resulting fifty liters of conditioned medium were filtered through a 0.45 µm cellulose acetate filter (Corning, Acton, Mass.), and characterized by SDS-PAGE analysis (data not shown). Further purification was accomplished as described in Example 42 herein below.

Example 42

Figure 49D:
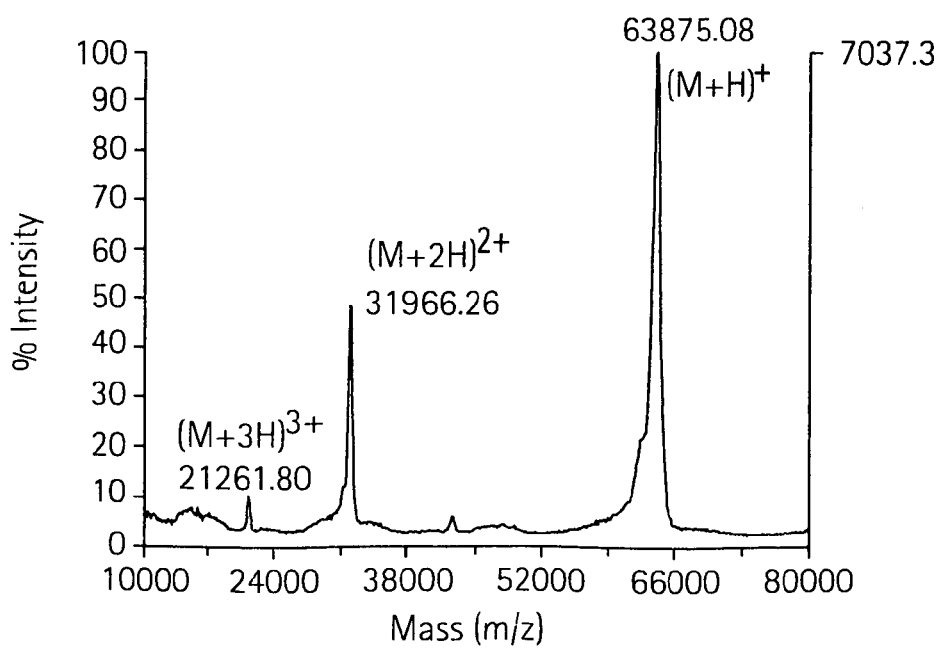

Purification of Fc-L10-OSK1, Fc-10-OSK1(K7S), Fc-L10-OSK1(E16K,K20D), and Fc-L10-OSK1 (K7S,E16K,K20D) Expressed by Mammalian Cells Purification of Fc-L10-OSK1. Approximately 6 L of CHO (AM1 CHOd-) cell-conditioned medium (see, Example 41 above) was loaded on to a 35 ml MAb Select column (GE Healthcare) at 10 ml/min 7° C., and the column was washed with several column volumes of Dulbecco's phosphate buffered saline without divalent cations (PBS) and sample was eluted with a step to 100 mM glycine pH 3.0. The MAb Select elution was directly loaded on to an inline 65 ml SP-HP column (GE Healthcare) in S-Buffer A (20 mM $NaH_2PO_4$, pH 7.0) at 10 ml/min 7° C. After disconnecting the MAb select column, the SP-HP column was then washed with several column volumes S-Buffer A, and then developed using a linear gradient from 5% to 60% S-Buffer B (20 mM $NaH_2PO_4$, 1 M NaCl, pH 7.0) at 10 ml/min followed by a step to 100% S-Buffer B at 7° C. Fractions were then analyzed using a Coomassie brilliant blue stained tris-glycine 4-20% SDS-PAGE, and the fractions containing the desired product were pooled based on these data. The pooled material was then concentrated to about 20 ml using a Pall Life Sciences Jumbosep 10K Omega centrifugal ultra-filtration device. The concentrated material was then buffer exchanged by diluting with 20 ml of 20 mM $NaH_2PO_4$, pH 7.0 and reconcentrated to 20 ml using the Jumbosep 10K Omega filter. The material was then diluted with 20 ml 20 mM $NaH_2PO_4$, 200 mM NaCl, pH 7.0 and then reconcentrated to 22 ml. The buffer exchanged material was then filtered though a Pall Life Sciences Acrodisc with a 0.22 µm, 25 mm Mustang E membrane at 1 ml/min room temperature. A spectral scan was then conducted on 50 µl of the filtered material diluted in 700 µl PBS using a Hewlett Packard 8453 spectrophotometer (FIG. 49A, black trace). The concentration of the filtered material was determined to be 4.96 mg/ml using a calculated molecular mass of 30,371 g/mol and extinction coefficient of 35,410 $M^{-1}$ $cm^{-1}$. The purity of the filtered material was then assessed using a Coomassie brilliant blue stained tris-glycine 4-20% SDS-PAGE (FIG. 49B). The endotoxin level was then determined using a Charles River Laboratories Endosafe-PTS system (0.05-5 EU/ml sensitivity) using a 30-fold dilution of the sample in Charles Rivers Laboratories Endotoxin Specific Buffer yielding a result of 1.8 EU/mg protein. The macromolecular state of the product was then determined using size exclusion chromatography on 149 µg of the product injected on to a Phenomenex BioSep SEC 3000 column (7.8×300 mm) in 50 mM $NaH_2PO_4$, 250 mM NaCl, pH 6.9 at 1 ml/min observing the absorbance at 280 nm (FIG. 49C). The product was then subject to mass spectral analysis by diluting 1 µl of the sample into 10 µl of sinapinic acid (10 mg per ml in 0.05% trifluroacetic acid, 50% acetonitrile). One milliliter of the resultant solution was spotted onto a MALDI sample plate. The sample was allowed to dry before being analyzed using a Voyager DE-RP time-of-flight mass spectrometer equipped with a nitrogen laser (337 nm, 3 ns pulse). The positive ion/linear mode was used, with an accelerating voltage of 25 kV. Each spectrum was produced by accumulating data from about 200 laser shots. External mass calibration was accomplished using purified proteins of known molecular masses. (FIG. 49D). The product was then stored at −80° C.

The yield for the mammalian Fc-L10-OSK1 prep was 115 mg from 6 L, the purity was >90% judging by SDS-PAGE; Fc-L10-OSK1 ran as the expected dimer judging by SEC-HPLC, and the mass is with the expected range judging by MS.

The activity of purified Fc-L10-OSK1 in blocking human Kv1.3 and human Kv1.1 is described in Example 43 herein below.

Figure 50A:
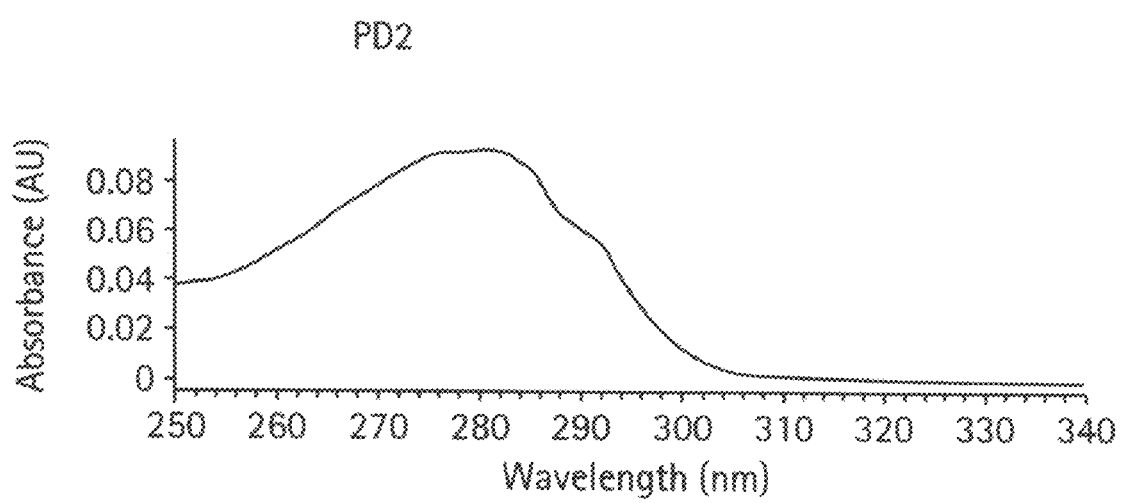
Figure 50B:
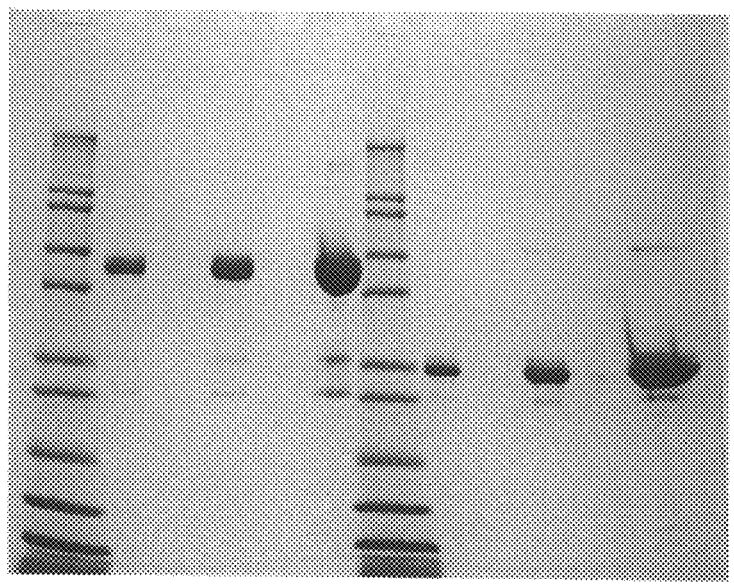
Figure 50C:
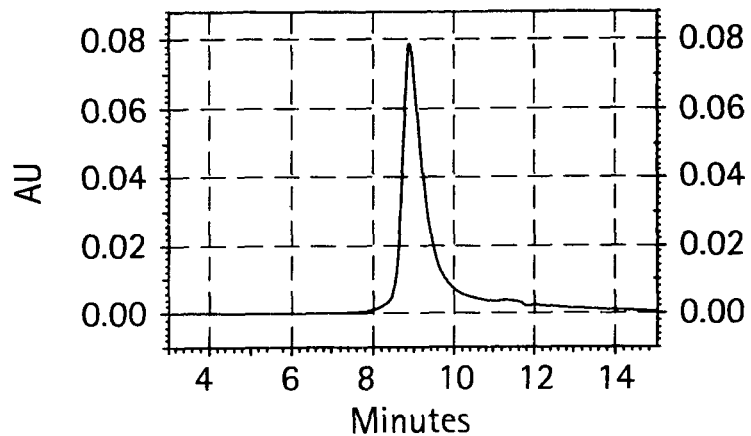
Figure 50D:
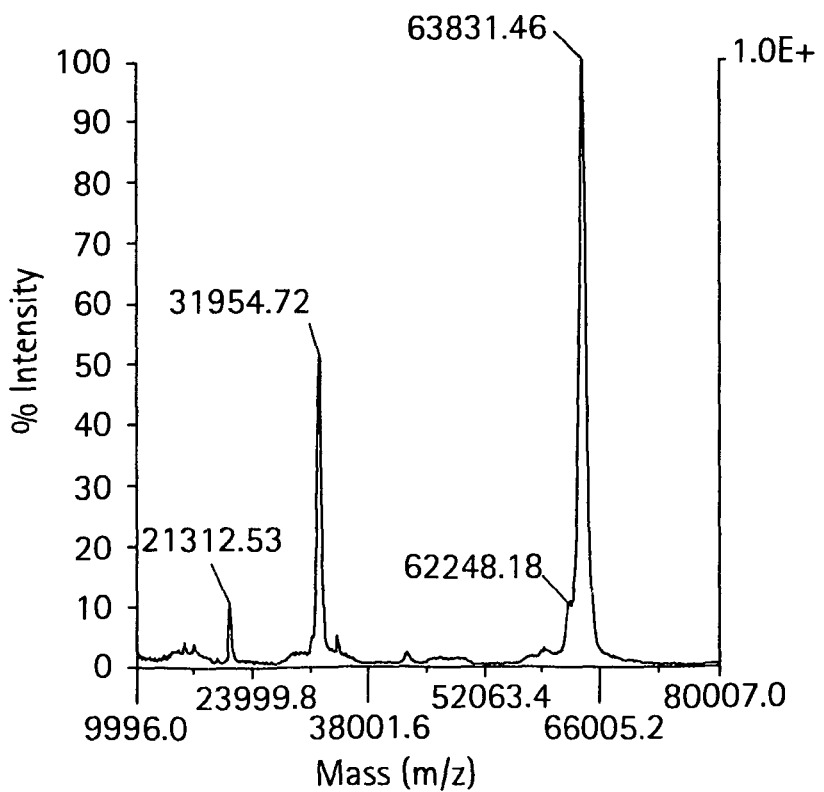
Figure 51A:
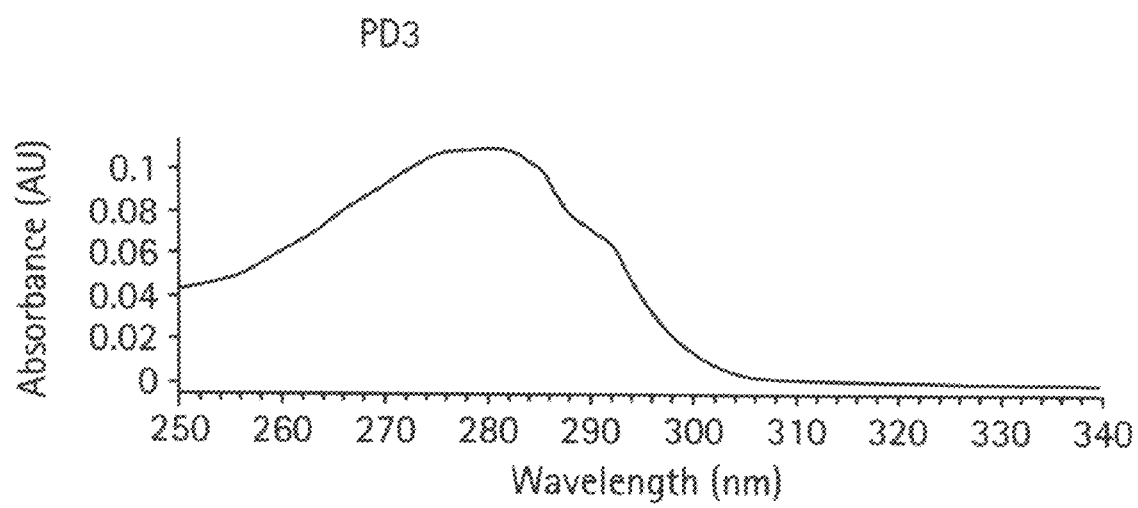
Figure 51B:
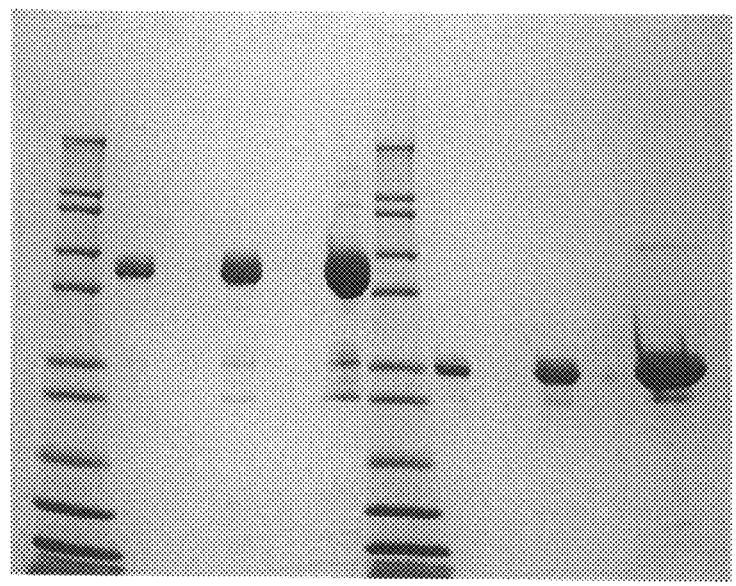
Figure 51C:
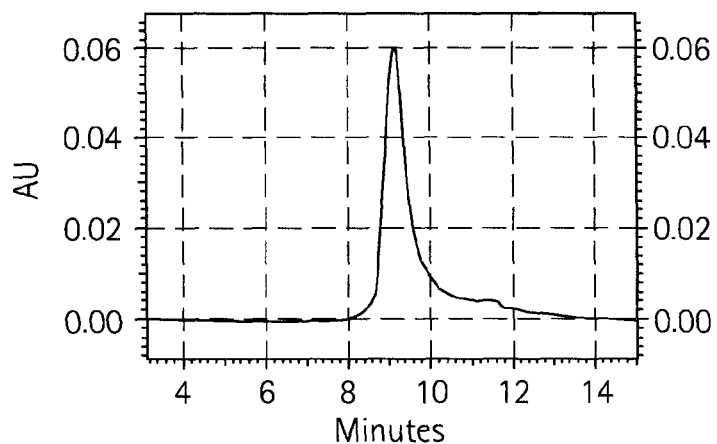
Figure 51D:
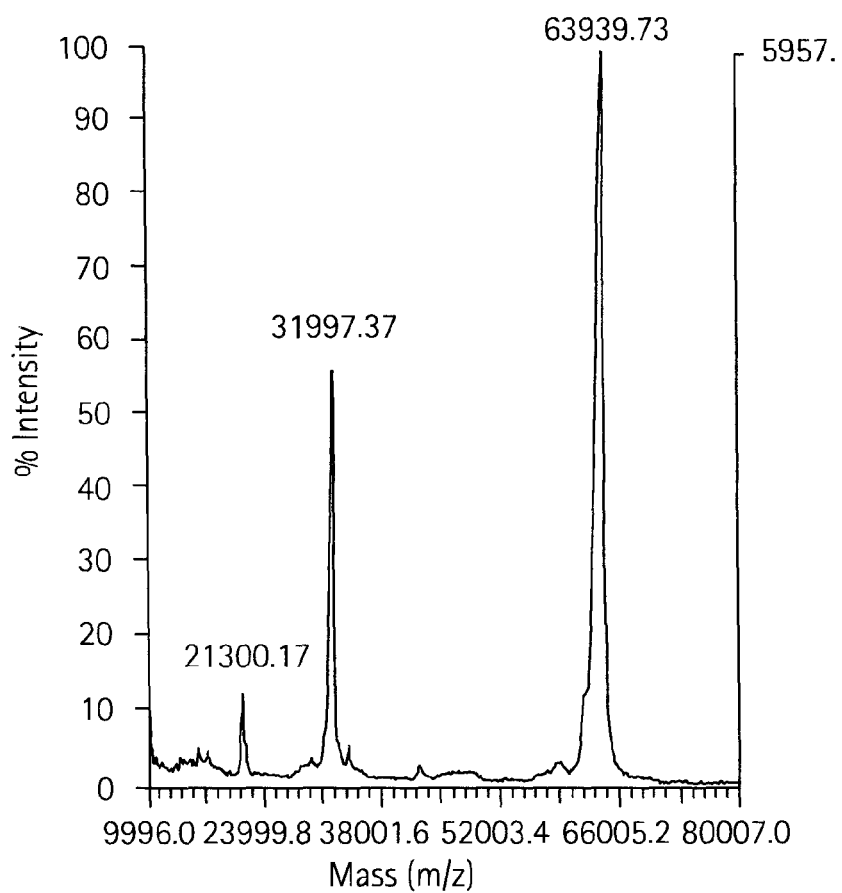
Figure 52A:
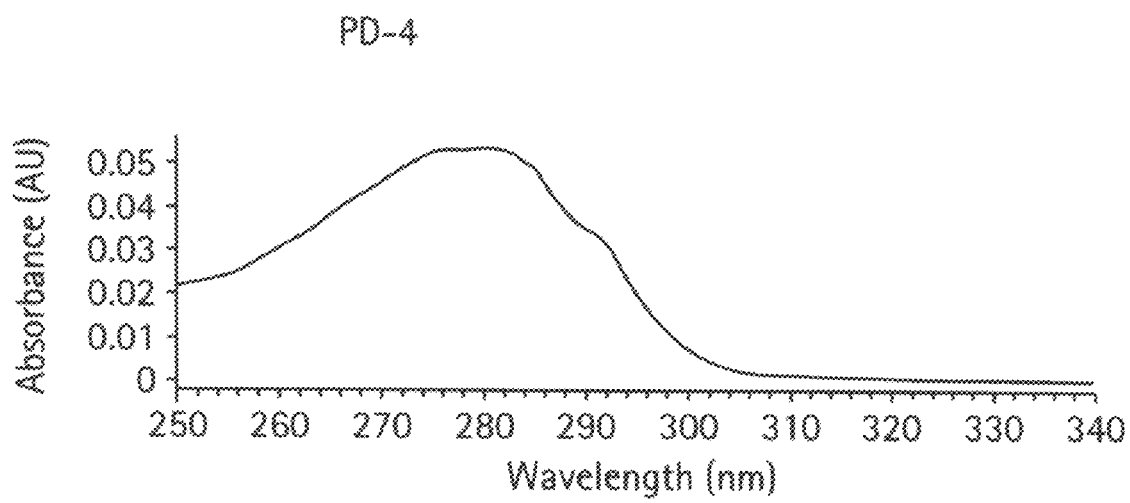
Figure 52B:
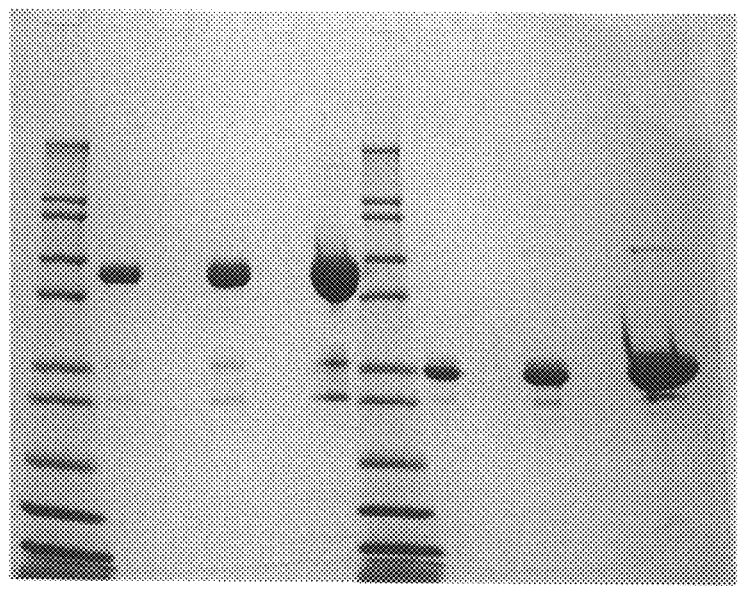
Figure 52C:
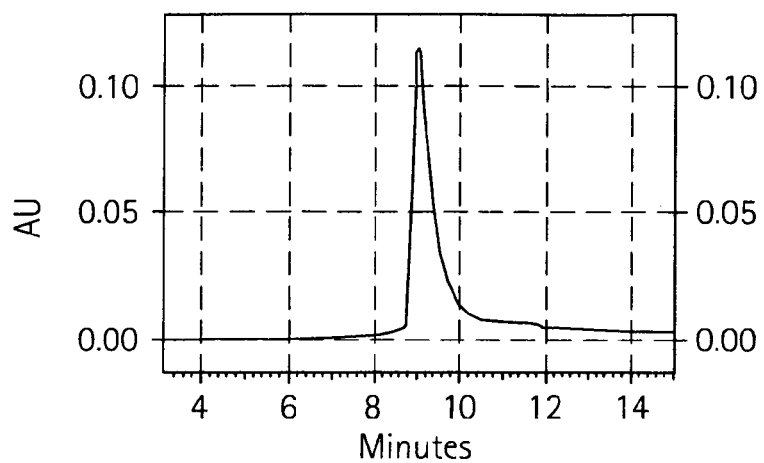
Figure 52D:
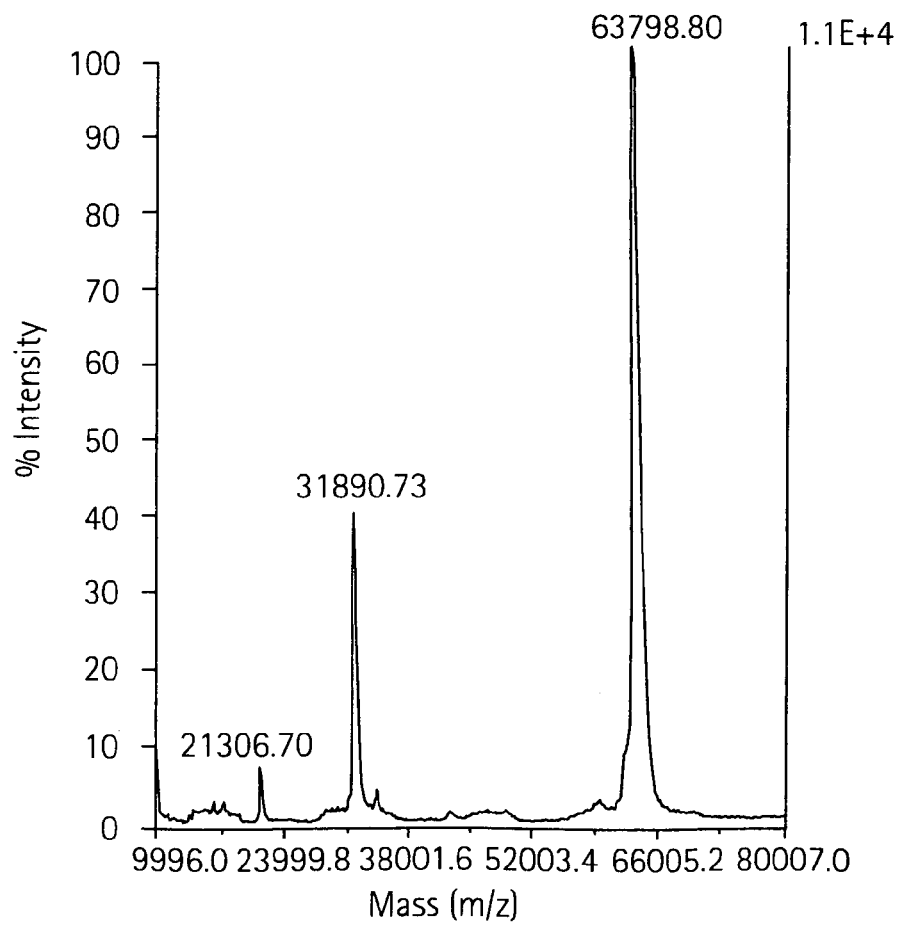

Purification of Fc-L10-OSK1(K7S), Fc-L10-OSK1 (E16K,K20D), and Fc-L10-OSK1(K7S,E16K,K20D). Approximately 500 mL of medium conditioned by transfected HEK-293 (see, Example 41 above) was combined with a 65% slurry of MAb Select resin (1.5 ml) (GE Healthcare) and 500 µl 20% $NaN_3$. The slurry was then gently agitated for 3 days at 4° C. followed by centrifugation at 1000 g for 5 minutes at 4° C. using no brake. The majority of the supernatant was then aspirated and the remaining slurry in the pellet was transferred to a 14 ml conical tube and combined with 12 ml of Dulbecco's phosphate buffered saline without divalent cations (PBS). The slurry was centrifuged at 2000 g for 1 minute at 4° C. using a low brake and the supernatant was aspirated. The PBS wash cycle was repeated an additional 3 times. The bound protein was then eluted by adding 1 ml of 100 mM glycine pH 3.0 and gently agitating for 5 min at room temperature. The slurry was then centrifuged at 2000 g for 1 minute at 4° C. using a low brake and the supernatant was aspirated as the first elution. The elution cycle was repeated 2 more times, and all 3 supernatants were combined into a single pool. Sodium acetate (37.5 µl of a 3 M solution) was added to the elution pool to raise the pH, which was then dialyzed against 10 mM acetic acid, 5% sorbitol, pH 5.0 for 2 hours at room temperature using a 10 kDa SlideAlyzer (Pierce). The dialysis buffer was changed, and the dialysis continued over night at 4° C. The dialyzed material was then filtered through a 0.22 µm cellulose acetate filter syringe filter. Then concentration of the filtered material was determined to be 1.27 mg/ml using a calculated molecular mass of 30,330 and extinction coefficient of 35,410 $M^{-1}$ $cm^{-1}$ (FIG. 50A). The purity of the filtered material was then assessed using a Coomassie brilliant blue stained tris-glycine 4-20% SDS-PAGE (FIG. 50B). The endotoxin level was then determined using a Charles River Laboratories Endosafe-PTS system (0.05-5 EU/ml sensitivity) using a 25-fold dilution of the sample in Charles Rivers Laboratories Endotoxin Specific Buffer yielding a result of <1 EU/mg protein. The macromolecular state of the product was then determined using size exclusion chromatography on 50 µg of the product injected on to a Phenomenex BioSep SEC 3000 column (7.8×300 mm) in 50 mM $NaH_2PO_4$, 250 mM NaCl, pH 6.9 at 1 ml/min observing the absorbance at 280 nm (FIG. 50C). The product was then subject to mass spectral analysis by diluting 1 µl of the sample into 10 µl of sinapinic acid (10 mg per ml in 0.05% trifluroacetic acid, 50% acetonitrile). One milliliter of the resultant solution was spotted onto a MALDI sample plate. The sample was allowed to dry before being analyzed using a Voyager DE-RP time-of-flight mass spectrometer equipped with a nitrogen laser (337 nm, 3 ns pulse). The positive ion/linear mode was used, with an accelerating voltage of 25 kV. Each spectrum was produced by accumulating data from ~200 laser shots. External mass calibration was accomplished using purified proteins of known molecular masses. (FIG. 50D). The product was then stored at −80° C.

FIGS. 51A-D show results from the purification and analysis for Fc-L10-OsK1(E16K, K20D), which was conducted using the same protocol as that for the Fc-L10-OsK1(K7S) molecule (described above) with the following exceptions: the concentration was found to be 1.59 mg/ml using a calculated molecular mass of 30,357 g/mol and a calculated extinction coefficient of 35,410; the pyrogen level was found to be <1 EU/mg using a 32-fold dilution.

FIGS. 52A-D show results from the purification and analysis for Fc-L10-OsK1(K7S,E16K, K20D), which was conducted using the same protocol as that for the Fc-L10-OsK1 (K7S) molecule (described above) with the following exceptions: the concentration was found to be 0.81 mg/ml using a calculated molecular mass of 30,316 g/mol and a calculated extinction coefficient of 35,410; the pyrogen level was found to be <1 EU/mg using a 16-fold dilution.

The activity of purified Fc-L10-OSK1[K7S], Fc-L10-OSK1[E16K, K20D] and Fc-L10-OSK1[K7S, E16K, K20D] in blocking human Kv1.3 and human Kv1.1 is described in Example 43 herein below.

Example 43

Electrophysiology of OSK1 and OSK1 Peptibody Analogs

Figure 53A:
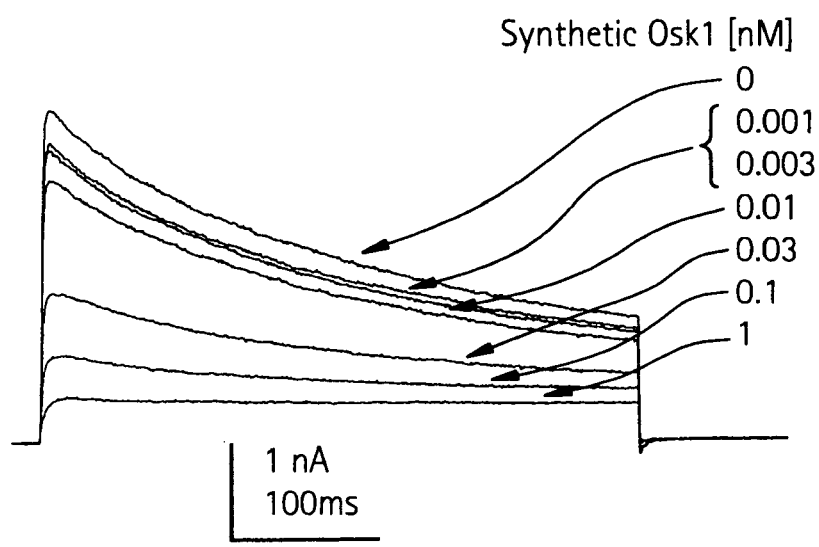
Figure 53B:
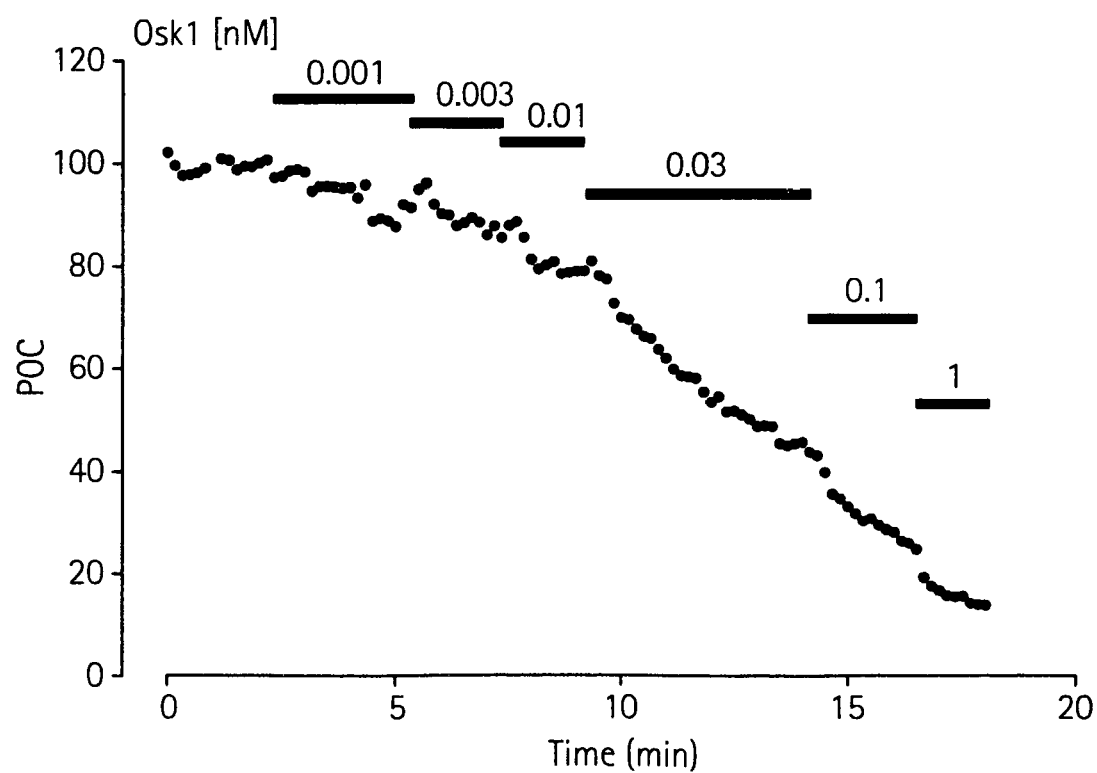

A 38-residue peptide toxin of the Asian scorpion *Orthochirus scrobiculosus* venom (OSK1) was synthesized (see, Examples 41) to evaluate its impact on the human Kv1.1 and Kv1.3 channels, subtypes of the potassium channel family. The potency and selectivity of synthetic OSK1 in inhibiting the human Kv1.1 and Kv1.3 channels was evaluated by the use of HEK293 cell expression system and electrophysiology (FIG. 53). Whole cell patch clamp recording of stably expressed Kv1.3 channels revealed that the synthetic OSK1 peptide is more potent in inhibiting human Kv1.3 when compared to Kv1.1 (Table 33).

Figure 54A:
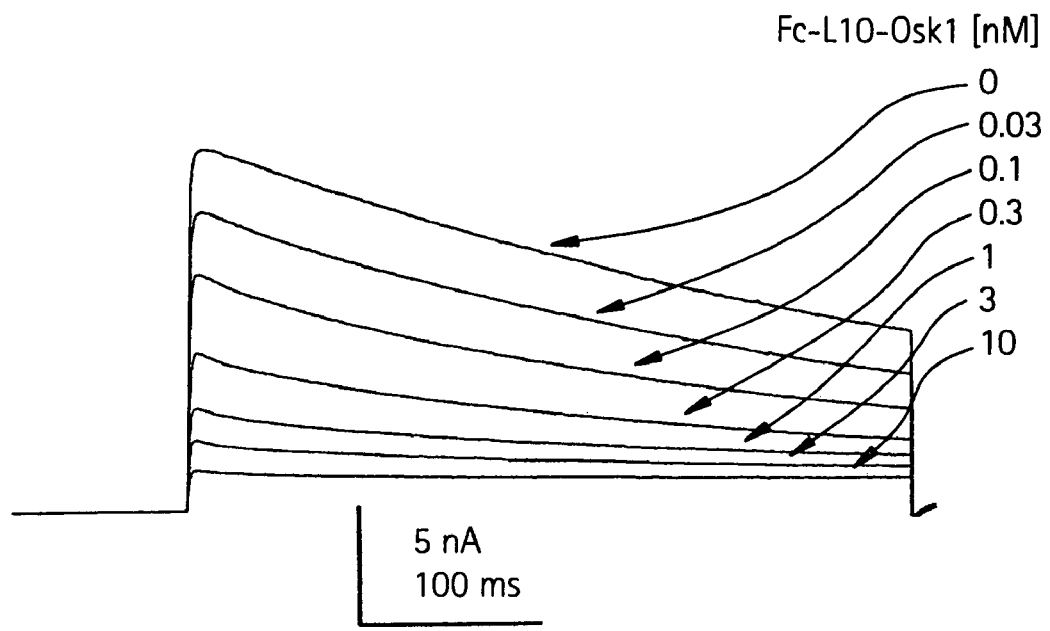
Figure 54B:
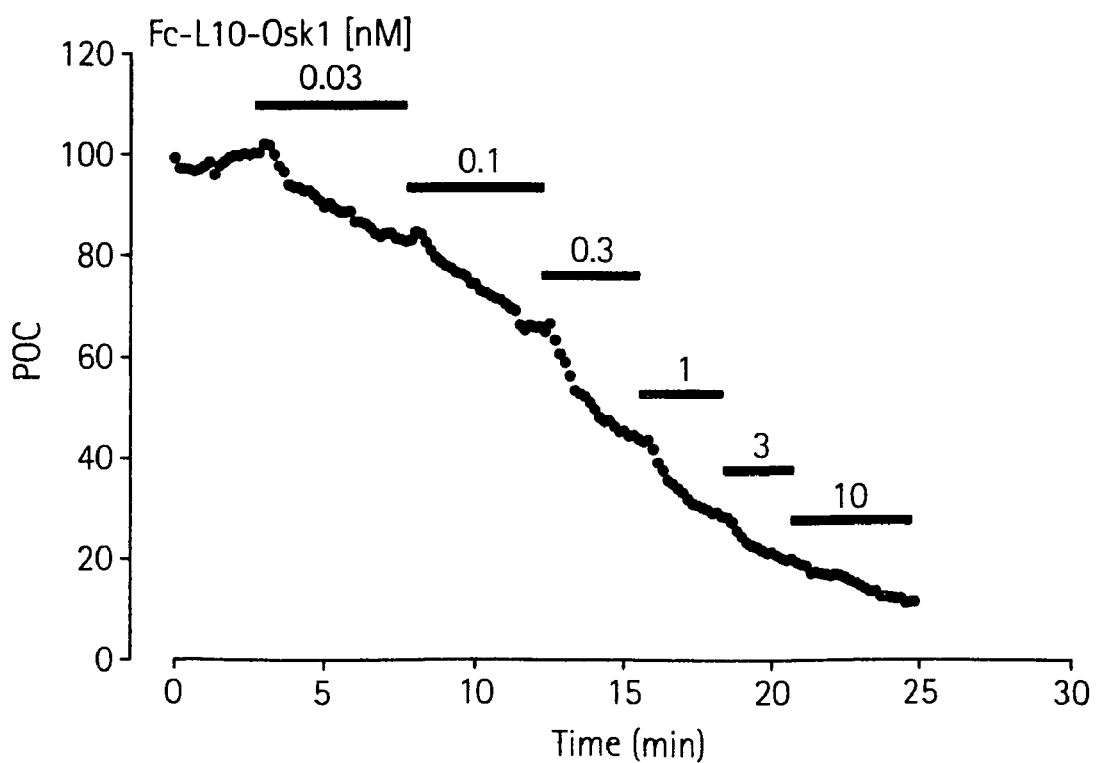

Fusion of OSK1 peptide toxin to antibody to generate OSK1 peptibody. To improve plasma half-life and prevent OSK1 peptide toxin from penetrating the CNS, the OSK1 peptide toxin was fused to the Fc-fragment of a human antibody IgG1 via a linker chain length of 10 amino acid residues (Fc-L10-OSK1), as described in Example 41 herein. This fusion resulted in a decrease in the potency of Kv1.3 by 5-fold when compared to the synthetic OSK1 peptide. However, it significantly improved the selectivity of OSK1 against Kv1.1 by 210-fold when compared to that of the synthetic peptide alone (4-fold; Table 33 and FIG. 54).

Modification of OSK1-peptibody (Fc-L10-OSK1). OSK1 shares 60 to 80% sequence homology to other members of scorpion toxins, which are collectively termed α-KTx3. Sequence alignment of OSK1 and other members of α-KTx3 family revealed 4 distinct structural differences at positions 12, 16, 20, and 36. These structural differences of OSK1 have been postulated to play an important role in its wide range of activities against other potassium channels, which is not observed with other members of α-KTx3 family. Hence, two amino acid residues at position 16 and 20 were restored to the more conserved amino acid residues within the OSK1 sequence in order to evaluate their impact on selectivity against other potassium channels such as Kv1.1, which is predominantly found in the CNS as a heterotetramer with Kv1.2. By substituting for glutamic acid at position 16, and for lysine at position 20, the conserved lysine and aspartic acid residues, respectively (i.e., Fc-L10-OSK1[E16K, K20D]), we did not observe a significant change in potency when compared to that of Fc-L10-OSK1 (1.3-fold difference; FIG. 56 and Table 33). However, this double mutation removed the blocking activity against Kv1.1. The selectivity ratio of Kv1.1/Kv1.3 was 403-fold, which was a significant improvement over the selectivity ratio for Fc-L10-OSK1 (210-fold). A single amino acid mutation at position 7 from lysine to serine (Fc-L10-OSK1[K7S]) produced a slight change in potency and selectivity by 2- and 1.3-fold, respectively, when compared to those of Fc-L10-OSK1 (FIG. 55 and Table 33). There was a significant decrease in potency as well as selectivity when all three residues were mutated to generate Fc-L10-OSK1[K7S, E16K, K20D] (FIG. 57 and Table 33).

As demonstrated by the results in Table 33, we dramatically improved selectivity against Kv1.1 by fusing the OSK1 peptide toxin to the Fc-fragment of the human antibody IgG1, but reduced target potency against Kv1.3. The selectivity against Kv1.1 was further improved when 2 residues at two key positions were restored to the conserved residues found in other members of the α-KTx3 family.

TABLE 33 shows a summary of IC50 values for OSK1 and OSK1 analogues against hKv1.3 and hKv1.1 channels. All analogues are ranked based on their potency against hKv1.3. Also shown in the table is the selectivity ratio of hKv1.1/hKv1.3 for all OSK1 analogues.

| Compound | hKv1.3:IC$_{50}$ [pM] | hKv1.1:IC$_{50}$ [pM] | hKv1.1/ hKv1.3 |
|---|---|---|---|
| Synthetic OSK1 | 39 | 160 | 4 |
| FC-L10-OSK1 | 198 | 41600 | 210 |
| Fc-L10-OSK1[E16K, K20D] | 248 | 100000 | 403 |
| Fc-L10-OSK1[K7S] | 372 | 100000 | 269 |
| Fc-L10-OSK1[K7S, E16K, K20D] | 812 | 10000 | 12 |

Example 44

Pharmacokinetic Study of PEG-ShK[1-35] Molecule in Rats

The intravenous (IV) pharmacokinetic profile was determined of a about 24-kDa 20K PEG-ShK[1-35] molecule and the about 4-kDa small native ShK peptide was determined in Spraque Dawley rats. The IV dose for the native ShK peptide and our novel 20K PEG-ShK[1-35] molecule was 1 mg/kg. This dose represented equal molar amounts of these two molecules. The average weight of the rats was about 0.3 kg and two rats were used for each dose & molecule. At various times following IV injection, blood was drawn and about 0.1 ml of serum was collected. Serum samples were stored frozen at −80° C. until analysis.

Assay Plate preparation for electrophysiology. Rat serum samples containing the 20K PEG-ShK[1-35] molecule or the native ShK peptide from pharmacokinetic studies were received frozen. Before experiments, each sample was thawed at room temperature and an aliquot (70 to 80 µl) was transferred to a well in a 96-well polypropylene plate. In order to prepare the Assay Plate, several dilutions were made from the pharmacokinetic serum samples to give rise to Test Solutions. Dilutions of serum samples from the pharmacokinetic study were into 10% Phosphate Buffered Saline (PBS, with $Ca^{2+}$ and $Mg^{2+}$). For determination of the amount of our novel 20K PEG-ShK[1-35] molecule in serum samples from the pharmacokinetic study, the final serum concentrations in the Test Solutions were 90%, 30%, 10%, 3.3% and 1.1%. Purified 20K PEG-Shk[1-35] Standard inhibition curves were also prepared in the Assay Plate. To do this, 8-point serial dilutions of the purified 20K PEG-ShK[1-35] molecule (Standard) were prepared in either 90%, 30%, 10%, 3.3% or 1.1% rat serum and the final concentration of standard was 50, 16.7, 5.5, 1.85, 0.62, 0.21, 0.068 and 0.023 nM.

Cell preparation for electrophysiology. CHO cells stably expressing the voltage-activated $K^+$ channel, $K_v1.3$ were plated in T-175 tissue culture flasks (at a density of 5×10$^6$) 2 days before experimentation and allowed to grow to around 95% confluence. Immediately prior to the experiment, the cells were washed with PBS and then detached with a 2 ml mixture (1:1 volume ratio) of trypsin (0.25%) and versene (1:5000) at 37° C. (for 3 minutes). Subsequently, the cells were re-suspended in the flask in 10 ml of tissue culture medium (HAM's F-12 with Glutamax, InVitrogen, Cat#31765) with 10% FBS, 1×NEAA and 750 µg/ml of G418) and centrifuged at about 1000 rpm for 1½ minutes. The resultant cell pellet was re-suspended in PBS at 3-5×10$^6$ cells/ml. IonWorks electrophysiology and data analysis. The ability of Test solutions or Standards in serum to inhibit K$^+$ currents in the CHO-K$_v$1.3 cells was investigated using the automated electrophysiology system, IonWorks Quattro. Re-suspended cells, the Assay Plate, a Population Patch Clamp (PPC) PatchPlate as well as appropriate intracellular (90 mMK-Gluconate, 20 mMKF, 2 mM NaCl, 1 mM MgCl2, 10 mM EGTA, 10 mM HEPES, pH 7.35) and extracellular (PBS, with Ca$^{2+}$ and Mg$^{2+}$) buffers were positioned on IonWorks Quattro. Electrophysiology recordings were made from the CHO-K$_v$1.3 cells using an amphotericin-based perforated patch-clamp method. Using the voltage-clamp circuitry of the IonWorks Quattro, cells were held at a membrane potential of −80 mV and voltage-activated K$^+$ currents were evoked by stepping the membrane potential to +30 mV for 400 ms. K$^+$ currents were evoked under control conditions i.e., in the absence of inhibitor at the beginning of the experiment and after 10-minute incubation in the presence of the Test Solution or Standard. The mean K$^+$ current amplitude was measured between 430 and 440 ms and the data were exported to a Microsoft Excel spreadsheet. The amplitude of the K$^+$ current in the presence of each concentration of the Test Solution or Standard was expressed as a percentage of the K$^+$ current in control conditions in the same well.

Standard inhibition curves were generated for each standard in various levels of rat serum and expressed as current percent of control (POC) versus log of nM concentration. Percent of control (POC) is inversely related to inhibition, where 100 POC is no inhibition and 0 POC is 100% inhibition. Linear regression over a selected region of the curve was used to derive an equation to enable calculation of drug concentrations within Test solutions. Only current values within the linear portion of the Standard curve were used to calculate the concentration of drug in Test solutions. The corresponding Standard curve in a given level of serum, was always compared to the same level of serum of Test solution when calculating drug level. The Standard curves for ShK and 20K PEG-ShK[1-35] are shown in FIG. 58A and FIG. 58B, respectively, and each figure contains linear regression equations for each Standard at a given percentage of serum. For the 20K PEG-ShK[1-35] standard curve the linear portion of the Standard curve was from 20 POC to 70 POC and only current values derived from the Test solution which fell within this range were used to calculate drug concentration within the Test solution.

The pharmacokinetic profile of our novel 20K PEG ShK [1-35] molecule after IV injection is shown in FIG. 59. The terminal half-life ($t_{1/2}$ b) of this molecule is estimated from this curve to be between 6 to 12 hours long. Beyond 48 hours, the level of drug falls outside the linear range of the Standard curve and is not calculated. The calculated 6 to 12 hour half-life of our novel 20K PEG-ShK[1-35] molecule was substantially longer than the approximately 0.33 hour (or 20 min) half-life of the native ShK molecule reported earlier by C. Beeton et al. [C. Beeton et al. (2001) Proc. Natl Acad. Sci. 98, 13942-13947], and is a desirable feature of a therapeutic molecule. A comparison of the relative levels of Kv1.3 inhibitor after an equal molar IV injection of ShK versus 20K PEG-ShK[1-35] is shown in FIG. 60. As can be seen from this figure examining 5% serum Test solutions, the 20K PEG-ShK [1-35] molecule showed significant suppression of Kv1.3 current (<70 POC) for more than 24 hours, whereas the native ShK peptide only showed a significant level of inhibition of Kv1.3 current for the first hour and beyond 1 hour showed no significant blockade. These data again demonstrate a desirable feature of the 20K PEG ShK[1-35] molecule as a therapeutic for treatment of autoimmune disease.

Example 45

PEGylated Toxin Peptide Suppressed Severe Autoimmune Encephalomyelitis in Animal Model The 20KPEG-ShK inhibitor of Kv1.3 shows improved efficacy in suppressing severe autoimmune encephalomyelitis in rats. Using an adoptive transfer experimental autoimmune encephalomyelitis (AT-EAE) model of multiple sclerosis described earlier [C. Beeton et al. (2001) J. Immunol. 166, 936], we examined the activity in vivo of our novel 20KPEG-ShK molecule and compared its efficacy to that of the ShK toxin peptide alone. The study design is illustrated in FIG. 61. The results from this in vivo study are provided in FIG. 62 and FIG. 63. The 20KPEG-ShK molecule delivered subcutaneously (SC) at 10 μg/kg daily from day −1 to day 3 significantly reduced disease severity and increased survival, whereas animals treated with an equal molar dose (10 μg/kg) of the small ShK peptide developed severe disease and died.

The 35-amino acid toxin peptide ShK (*Stichodactyla helianthus* neurotoxin) was purchased from Bachem Bioscience Inc and confirmed by electrophysiology to potently block Kv1.3 (see Example 36 herein). The synthesis, PEGylation and purification of the 20KPEG ShK molecule was as described herein above. The encephalomyelogenic CD4+ rat T cell line, PAS, specific for myelin-basic protein (MBP) originated from Dr. Evelyne Beraud; The maintenance of these cells in vitro and their use in the AT-EAE model has been described earlier [C. Beeton et al. (2001) PNAS 98, 13942]. PAS T cells were maintained in vitro by alternating rounds of antigen stimulation or activation with MBP and irradiated thymocytes (2 days), and propagation with T cell growth factors (5 days). Activation of PAS T cells (3×10$^5$/ml) involved incubating the cells for 2 days with 10 μg/ml MBP and 15×10$^6$/ml syngeneic irradiated (3500 rad) thymocytes. On day 2 after in vitro activation, 10-15×10$^6$ viable PAS T cells were injected into 6-12 week old female Lewis rats (Charles River Laboratories) by tail IV. Daily subcutaneous injections of vehicle (2% Lewis rat serum in PBS), 20KPEG-ShK or ShK were given from days −1 to 3 (FIG. 61), where day −1 represent 1 day prior to injection of PAS T cells (day 0). In vehicle treated rats, acute EAE developed 4 to 5 days after injection of PAS T cells (FIG. 62). Serum was collected by retro-orbital bleeding at day 4 and by cardiac puncture at day 8 (end of the study) for analysis of levels of inhibitor. Rats were weighed on days −1, 4, 6, and 8. Animals were scored blinded once a day from the day of cell transfer (day 0) to day 3, and twice a day from day 4 to day 8. Clinical signs were evaluated as the total score of the degree of paresis of each limb and tail. Clinical scoring: 0=No signs, 0.5=distal limp tail, 1.0=limp tail, 2.0=mild paraparesis, ataxia, 3.0=moderate paraparesis, 3.5=one hind leg paralysis, 4.0=complete hind leg paralysis, 5.0=complete hind leg paralysis and incontinence, 5.5=tetraplegia, 6.0=moribund state or death. Rats reaching a score of 5.5 were euthanized.

Treatment of rats with the Kv1.3 blocker PEG-ShK prior to the onset of EAE caused a lag in the onset of disease, inhibited the progression of disease, and prevented death in a dose-dependent manner (FIG. 62). Onset of disease in rats that were treated with the vehicle alone, 10 μg/kg ShK or 1 μg/kg of PEG-ShK was observed on day 4, compared to day 4.5 in rats treated with 10 μg/kg PEG-ShK or 100 μg/kg PEG-ShK. In addition, rats treated with vehicle alone, 10 μg/kg ShK or 1 μg/kg of PEG-ShK all developed severe disease by the end of the study with an EAE score of 5.5 or above. In contrast, rats treated with 10 μg/kg PEG-ShK or 100 μg/kg PEG-ShK, reached a peak clinical severity score average of <2, and all but one rat survived to the end of the study. Furthermore, we found that rat body weight correlated with disease severity (FIG. 63). Rats treated with vehicle alone, 10 μg/kg ShK or 1 ug/kg of PEG-ShK all lost an average of 31 g, 30 g, and 30 g, respectively, while rats treated with 10 μg/kg PEG-ShK or 100 μg/kg PEG-ShK lost 18 g and 11 g, respectively. Rats in the latter two groups also appeared to be gaining weight by the end of the study, a sign of recovery. It should be noted that rats treated with 10 μg/kg ShK and 10 μg/kg PEG-ShK received molar equivalents of the ShK peptide. The significantly greater efficacy of the PEG-ShK molecule relative to unconjugated ShK, is likely due to the PEG-ShK molecule's greater stability and prolonged half-life in vivo (see, Example 44).

Example 46

Compositions Including Kv1.3 Antagonist Peptides Block Inflammation in Human Whole Blood Ex vivo assay to examine impact of Kv1.3 inhibitors on secretion of IL-2 and IFN-g. Human whole blood was obtained from healthy, non-medicated donors in a heparin vacutainer. DMEM complete media was Iscoves DMEM (with L-glutamine and 25 mM Hepes buffer) containing 0.1% human albumin (Bayer #68471), 55 μM 2-mercaptoethanol (Gibco), and 1× Pen-Strep-Gln (PSG, Gibco, Cat#10378-016). Thapsigargin was obtained from Alomone Labs (Israel). A 10 mM stock solution of thapsigargin in 100% DMSO was diluted with DMEM complete media to a 40 μM, 4× solution to provide the 4× thapsigargin stimulus for calcium mobilization. The Kv1.3 inhibitor peptide ShK (Stichodacytla helianthus toxin, Cat# H2358) and the BKCa1 inhibitor peptide IbTx (Iberiotoxin, Cat# H9940) were purchased from Bachem Biosciences, whereas the Kv1.1 inhibitor peptide DTX-k (Dendrotoxin-K) was from Alomone Labs (Israel). The CHO-derived Fc-L10-ShK[2-35] peptibody inhibitor of Kv1.3 was obtained as described herein at Example 4 and Example 39. The calcineurin inhibitor cyclosporin A was obtained from the Amgen sample bank, but is also available commercially from a variety of vendors. Ten 3-fold serial dilutions of inhibitors were prepared in DMEM complete media at 4× final concentration and 50 μl of each were added to wells of a 96-well Falcon 3075 flat-bottom microtiter plate. Whereas columns 1-5 and 7-11 of the microtiter plate contained inhibitors (each row with a separate inhibitor dilution series), 50 μl of DMEM complete media alone was added to the 8 wells in column 6 and 100 μl of DMEM complete media alone was added to the 8 wells in column 12. To initiate the experiment, 100 μl of whole blood was added to each well of the microtiter plate. The plate was then incubated at 37° C., 5% $CO_2$ for one hour. After one hour, the plate was removed and 50 μl of the 4× thapsigargin stimulus (40 μM) was added to all wells of the plate, except the 8 wells in column 12. The plates were placed back at 37° C., 5% $CO_2$ for 48 hours. To determine the amount of IL-2 and IFN-g secreted in whole blood, 100 μl of the supernatant (conditioned media) from each well of the 96-well plate was transferred to a storage plate. For MSD electrochemilluminesence analysis of cytokine production, 20 μl of the supernatants (conditioned media) were added to MSD Multi-Spot Custom Coated plates (www.meso-scale.com). The working electrodes on these plates were coated with four Capture Antibodies (hIL-5, hIL-2, hIFNg and hIL-4) in advance. After addition of 20 μl of conditioned media to the MSD plate, 150 μl of a cocktail of Detection Antibodies and P4 Buffer were added to each well. The 150 μl cocktail contained 20 ul of four Detection Antibodies (hIL-5, hIL-2, hIFNg and hIL-4) at 1 μg/ml each and 130 ul of 2×P4 Buffer. The plates were covered and placed on a shaking platform overnight (in the dark). The next morning the plates were read on the MSD Sector Imager. Since the 8 wells in column 6 of each plate received only the thapsigargin stimulus and no inhibitor, the average MSD response here was used to calculate the "High" value for a plate. The calculate "Low" value for the plate was derived from the average MSD response from the 8 wells in column 12 which contained no thapsigargin stimulus and no inhibitor. Percent of control (POC) is a measure of the response relative to the unstimulated versus stimulated controls, where 100 POC is equivalent to the average response of thapsigargin stimulus alone or the "High" value. Therefore, 100 POC represents 0% inhibition of the response. In contrast, 0 POC represents 100% inhibition of the response and would be equivalent to the response where no stimulus is given or the "Low" value. To calculate percent of control (POC), the following formula is used: [(MSD response of well)–("Low")]/[("High")–("Low")]×100. The potency of the molecules in whole blood was calculated after curve fitting from the inhibition curve (IC) and IC50 was derived using standard curve fitting software. Although we describe here measurement of cytokine production using a high throughput MSD electrochemilluminescence assay, one of skill in the art can readily envision lower throughput ELISA assays are equally applicable for measuring cytokine production.

Ex vivo assay demonstrating Kv1.3 inhibitors block cell surface activation of CD40L & IL-2R. Human whole blood was obtained from healthy, non-medicated donors in a heparin vacutainer. DMEM complete media was Iscoves DMEM (with L-glutamine and 25 mM Hepes buffer) containing 0.1% human albumin (Bayer #68471), 55 μM 2-mercaptoethanol (Gibco), and 1× Pen-Strep-Gln (PSG, Gibco, Cat#10378-016). Thapsigargin was obtained from Alomone Labs (Israel). A 10 mM stock solution of thapsigargin in 100% DMSO was diluted with DMEM complete media to a 40 μM, 4× solution to provide the 4× thapsigargin stimulus for calcium mobilization. The Kv1.3 inhibitor peptide peptide ShK (Stichodacytla helianthus toxin, Cat# H2358) and the BKCa1 inhibitor peptide IbTx (iberiotoxin, Cat# H9940) were purchased from Bachem Biosciences, whereas the Kv1.1 inhibitor peptide DTX-k (Dendrotoxin-K) was from Alomone Labs (Israel). The CHO-derived Fc-L10-ShK[2-35] peptibody inhibitor of Kv1.3 was obtained as described in Example 4 and Example 39. The calcineurin inhibitor cyclosporin A was obtained from the Amgen sample bank, but is also available commercially from a variety of vendors. The ion channel inhibitors ShK, IbTx or DTK-k were diluted into DMEM complete media to 4× of the final concentration desired (final=50 or 100 nM). The calcineurin inhibitor cyclosporin A was also diluted into DMEM complete media to 4× final concentration (final=10 μM). To appropriate wells of a 96-well Falcon 3075 flat-bottom microtiter plate, 50 μl of either DMEM complete media or the 4× inhibitor solutions were added. Then, 100 μl of human whole blood was added and the plate was incubated for 1 hour at 37° C., 5% $CO_2$. After one hour, the plate was removed and 50 μl of the 4×thapsigargin stimulus (40 μM) was added to all wells of the plate containing inhibitor. To some wells containing no inhibitor but just DMEM complete media, thapsigargin was also added whereas others wells with just DMEM complete media had an additional 50 μl of DMEM complete media added. The wells with no inhibitor and no thapsigargin stimulus represented the untreated "Low" control. The wells with no inhibitor but which received thapsigargin stimulus represented the control for maximum stimulation or "High" control. Plates were placed back at 37° C., 5% $CO_2$ for 24 hours. After 24 hours, plates were removed and wells were process for FACS analysis. Cells were removed from the wells and washed in staining buffer (phosphate buffered saline containing 2% heat-inactivated fetal calf serum). Red blood cells were lysed using BD FACS Lysing Solution containing 1.5% formaldehyde (BD Biosciences) as directed by the manufacturer. Cells were distributed at a concentration of 1 million cells per 100 microliters of staining buffer per tube. Cells were first stained with 1 microliter of biotin-labeled anti-human CD4, washed, then stained simultaneously 1 microliter each of streptavidin-APC, FITC-labeled anti-human CD45RA, and phycoerythrin (PE)-labeled anti-human CD25 (IL-2Ra) or PE-labeled anti-human CD40L. Cells were washed with staining buffer between antibody addition steps. All antibodies were obtained from BD Biosciences (San Diego, Calif.). Twenty to fifty thousand live events were collected for each sample on a Becton Dickinson FACSCaliber (Mountain View, Calif.) flow cytometer and analyzed using FlowJo software (Tree Star Inc., San Carlos, Calif.). Dead cells, monocytes, and granulocytes were excluded from the analysis on the basis of forward and side scatter properties.

FIG. 64 and FIG. 67 demonstrate that Kv1.3 inhibitors ShK and Fc-L10-ShK[2-35] potently blocked IL-2 secretion in human whole blood, in addition to suppressing activation of the IL-2R on CD4+ T cells. The Kv1.3 inhibitor Fc-L10-ShK [2-35] was more than 200 times more potent in blocking IL-2 production in human whole blood than cyclosporine A (FIG. 64) as reflected by the IC50. FIG. 65 shows that Kv1.3 inhibitors also potently blocked secretion of IFNg in human whole blood, and FIG. 66 demonstrates that upregulation of CD40L on T cells was additionally blocked. The data in FIGS. 64-67 show that the Fc-L10-ShK[2-35] molecule was stable in whole blood at 37° C. for up to 48 hours, providing potent blockade of inflammatory responses. Toxin peptide therapeutic agents that target Kv1.3 and have prolonged half-life, are sought to provide sustained blockade of these responses in vivo over time. In contrast, despite the fact the Kv1.3 inhibitor peptide ShK also showed potent blockade in whole blood, the ShK peptide has a short (~20 min) half-life in vivo (C. Beeton et al. (2001) Proc. Natl. Acad. Sci. 98, 13942), and cannot, therefore, provide prolonged blockade. Whole blood represents a physiologically relevant assay to predict the response in animals. The whole blood assays described here can also be used as a pharmacodynamic (PD) assay to measure target coverage and drug exposure following dosing of patients. These human whole blood data support the therapeutic usefulness of the compositions of the present invention for treatment of a variety immune disorders, such as multiple sclerosis, type 1 diabetes, psoriasis, inflammatory bowel disease, contact-mediated dermatitis, rheumatoid arthritis, psoriatic arthritis, asthma, allergy, restinosis, systemic sclerosis, fibrosis, scleroderma, glomerulonephritis, Sjogren syndrome, inflammatory bone resorption, transplant rejection, graft-versus-host disease, and lupus.

Example 47

PEGylated Peptibodies

By way of example, PEGylated peptibodies of the present invention were made by the following method. CHO-expressed FcL10-OsK1 (19.2 mg; MW 30,371 Da, 0.63 micro- mole) in 19.2 ml A5S, 20 mM $NaBH_3CN$, pH 5, was treated with 38 mg PEG aldehyde (MW 20 kDa; 3×, Lot 104086). The sealed reaction mixture was stirred in a cold room overnight. The extent of the protein modification during the course of the reaction was monitored by SEC HPLC using a Superose 6 HR 10/30 column (Amersham Pharmacia Biotech) eluted with a 0.05 M phosphate buffer, 0.5 M NaCl, pH 7.0 at 0.4 ml/min. The reaction mixture was dialyzed with A5S, pH 5 overnight. The dialyzed material was then loaded onto an SP HP FPLC column (16/10) in A5S pH 5 and eluted with a 1 M NaCl gradient. The collected fractions were analyzed by SEC HPLC, pooled into 3 pools, exchanged into DPBS, concentrated and submitted for functional testing (Table 34).

In another example, FcL10-ShK1 (16.5 mg; MW 30,065 Da, 0.55 micro mole) in 16.5 ml A5S, 20 mM $NaBH_3CN$, pH 5 was treated with 44 mg PEG aldehyde (MW 20 kDa; 4×, Lot 104086). The sealed reaction mixture was stirred in a cold room overnight. The extent of the protein modification during the course of the reaction was monitored by SEC HPLC using a Superose 6 HR 10/30 column (Amersham Pharmacia Biotech) eluted with a 0.05 M phosphate buffer, 0.5 M NaCl, pH 7.0 at 0.4 ml/min. The reaction mixture was dialyzed with A5S, pH 5 overnight. The dialyzed material was loaded onto an SP HP FPLC column (16/10) in A5S pH 5 and was eluted with a 1 M NaCl gradient. The collected fractions were analyzed by SEC HPLC, pooled into 3 pools, exchanged into DPBS, concentrated and submitted for functional testing (Table 34).

The data in Table 34 demonstrate potency of the PEGylated peptibody molecules as Kv1.3 inhibitors.

TABLE 34 shows determinations of IC50 made by whole cell patch clamp electrophysiology with HEK 293 as described in Example 36 herein above. The sustained IC50 was derived from the current 400 msecs after voltage ramp from −80 mV to +30 mV. Pool #2 samples comprised di-PEGylated peptibodies and Pool #3 samples comprised mono-PEGylated peptibodies.

| PEGylated Peptibody | Pool # | IC50 Sustained (nM) |
|---|---|---|
| PEG-Fc-L10-SHK(2-35) | 3 | 0.175(n = 4) |
| PEG-Fc-L10-SHK(2-35) | 2 | 0.158(n = 4) |
| PEG-FC-L10-OSK1 | 3 | 0.256(n = 3) |
| PEG-FC-L10-OSK1 | 2 | 0.332(n = 3) |

Example 48

PEGylated Toxin Peptides

Shk and Osk-1 PEGylation, purification and analysis. Synthetic Shk or OSK1-1 toxin peptides were selectively PEGylated by reductive alkylation at their N-termini. Conjugation was achieved, with either Shk or OSK-1 toxin peptides, at 2 mg/ml in 50 mM $NaH_2PO_4$, pH 4.5 reaction buffer containing 20 mM sodium cyanoborohydride and a 2 molar excess of 20 kDa monomethoxy-PEG-aldehyde (Nektar Therapeutics, Huntsville, Ala.). Conjugation reactions were stirred overnight at room temperature, and their progress was monitored by RP-HPLC. Completed reactions were quenched by 4-fold dilution with 20 mM NaOAc, pH 4, adjusted to pH 3.5 and chilled to 4° C. The PEG-peptides were then purified chromatographically at 4° C.; using SP Sepharose HP columns (GE Healthcare, Piscataway, N.J.) eluted with linear 0-1M NaCl gradients in 20 mM NaOAc, pH 4.0. (FIG. 68A and FIG. 68B) Eluted peak fractions were analyzed by SDS- PAGE and RP-HPLC and pooling determined by purity >97%. Principle contaminants observed were di-PEGylated toxin peptide and unmodified toxin peptide. Selected pools were concentrated to 2-5 mg/ml by centrifugal filtration against 3 kDa MWCO membranes and dialyzed into 10 mM NaOAc, pH 4 with 5% sorbitol. Dialyzed pools were then sterile filtered through 0.2 micron filters and purity determined to be >97% by SDS-PAGE and RP-HPLC (FIG. 69A and FIG. 69B). Reverse-phase HPLC was performed on an Agilent 1100 model HPLC running a Zorbax 5 μm 300SB-C8 4.6×50 mm column (Phenomenex) in 0.1% $TFA/H_2O$ at 1 ml/min and column temperature maintained at 40° C. Samples of PEG-peptide (20 μg) were injected and eluted in a linear 6-60% gradient while monitoring wavelengths 215 nm and 280 nm.

Electrophysiology performed by patch clamp on whole cells (see, Example 36) yielded a peak IC50 of 1.285 nM for PEG-OSK1 and 0.169 nM for PEG-ShK[1-35] (FIG. 74), in a concentration dependent block of the outward potassium current recorded from HEK293 cells stably expressing human Kv1.3 channel. The purified PEG-ShK[1-35] molecule, also referred to as "20K PEG-ShK[1-35]" and "PEG-ShK", had a much longer half-life in vivo than the small ShK peptide (FIG. 59 and FIG. 60). PEG-ShK[1-35] suppressed severe autoimmune encephalomyelitis in rats (Example 45, FIGS. 61-63) and showed greater efficacy than the small native ShK peptide.

Example 49

Fc Loop Insertions of ShK and OSK1 Toxin Peptides

As exemplified in FIG. 70, FIG. 71, FIG. 72, and FIG. 73, disulphide-constrained toxin peptides were inserted into the human IgG1 Fc-loop domain, defined as the sequence $D_{137}E_{138}L_{139}T_{140}K_{141}$, according to the method published in Example 1 in Gegg et al., Modified Fc molecules, WO 2006/036834 A2 [PCT/US2005/034273]). Exemplary FcLoop-L2-OsK1-L2, FcLoop-L2-ShK-L2, FcLoop-L2-ShK-L4, and FcLoop-L4-OsK1-L2 were made having three linked domains. These were collected, purified and submitted for functional testing.

The peptide insertion for these examples was between Fc residues $Leu_{139}$ and $Thr_{140}$ and included 2-4 Gly residues as linkers flanking either side of the inserted peptide. However, alternate insertion sites for the human IgG1 Fc sequence, or different linkers, are also useful in the practice of the present invention, as is known in the art, e.g., as described in Example 13 of Gegg et al., Modified Fc molecules, WO 2006/036834 A2 [PCT/US2005/034273]).

Example 50

Purification of ShK(2-35)-L-Fc from *E. coli*

Frozen, *E. coli* paste (117 g), obtained as described in Example 16 herein above, was combined with 1200 ml of room temperature 50 mM tris HCl, 5 mM EDTA, pH 7.5 and was brought to about 0.1 mg/ml hen egg white lysozyme. The suspended paste was passed through a chilled microfluidizer twice at 12,000 PSI. The cell lysate was then centrifuged at 17,700 g for 30 min at 4° C. The pellet was then resuspended in 1200 ml 1% deoxycholic acid using a tissue grinder and then centrifuged at 17,700 g for 30 min at 4° C. The pellet was then resuspended in 1200 ml water using a tissue grinder and then centrifuged at 17,700 g for 30 min at 4° C. 6.4 g of the pellet (total 14.2g) was then dissolved in 128 ml 8 M guanidine HCl, 50 mM tris HCl, pH 8.0. 120 ml of the pellet solution was then incubated with 0.67 ml of 1 M DTT for 60 min at 37° C. The reduced material was transferred to 5500 ml of the refolding buffer (3 M urea, 50 mM tris, 160 mM arginine HCl, 2.5 mM EDTA, 2.5 mM cystamine HCl, 4 mM cysteine, pH 9.5) at 2 ml/min, 4° C. with vigorous stirring. The stirring rate was then slowed and the incubation was continued for 3 days at 4° C.

The refold was diluted with 5.5 L of water, and the pH was adjusted to 8.0 using acetic acid, then the solution was filtered through a 0.22 μm cellulose acetate filter and loaded on to a 35 ml Amersham Q Sepharose-FF (2.6 cm I.D.) column at 10 ml/min in Q-Buffer A (20 mM Tris, pH 8.5) at 8° C. with an inline 35 ml Amersham Mab Select column (2.6 cm I.D.). After loading, the Q Sepharose column was removed from the circuit, and the remaining chromatography was carried out on the Mab Select column. The column was washed with several column volumes of Q-Buffer A, followed by elution using a step to 100 mM glycine pH 3.0. The fractions containing the desired product immediately loaded on to a 5.0 ml Amersham SP-Sepharose HP column at 5.0 ml/min in S-Buffer A (10 mM $NaH_2PO_4$, pH 7.0) at 8° C. The column was then washed with several column volumes of S-Buffer A followed by a linear gradient from 5% to 60% S-Buffer B (10 mM $NaH_2PO_4$, 1 M NaCl, pH 7.0) followed by a step to 100% S-Buffer B. Fractions were then analyzed using a Coomassie brilliant blue stained tris-glycine 4-20% SDS-PAGE. The fractions containing the bulk of the desired product were pooled and then applied to a 50 ml MEP Hypercel column (2.6 cm I.D.) at 10 ml/min in MEP Buffer A (20 mM tris, 200 mM NaCl, pH 8.0) at 8° C. Column was eluted with a linear gradient from 5% to 50% MEP Buffer B (50 mM sodium citrate pH 4.0) followed by a step to 100% MEP Buffer B. Fractions were then analyzed using a Coomassie brilliant blue stained tris-glycine 4-20% SDS-PAGE, and the fractions containing the bulk of the desired product were pooled.

The MEP-pool was then concentrated to about 10 ml using a Pall Jumbo-Sep with a 10 kDa membrane. A spectral scan was then conducted on 50 μl of the combined pool diluted in 700 μl PBS using a Hewlett Packard 8453 spectrophotometer (FIG. 76A). Then concentration of the material was determined to be 3.7 mg/ml using a calculated molecular mass of 30,253 and extinction coefficient of 36,900 $M^{-1}$ $cm^{-1}$. The purity of the material was then assessed using a Coomassie brilliant blue stained tris-glycine 4-20% SDS-PAGE (FIG. 76B). The macromolecular state of the product was then determined using size exclusion chromatography on 70 μg of the product injected on to a Phenomenex BioSep SEC 3000 column (7.8×300 mm) in 50 mM $NaH_2PO_4$, 250 mM NaCl, pH 6.9 at 1 ml/min observing the absorbance at 280 nm (FIG. 76C). The product was then subject to mass spectral analysis by chromatographing approximately 4 μg of the sample through a RP-HPLC column (Vydac $C_4$, 1×150 mm). Solvent A was 0.1% trifluoroacetic acid in water and solvent B was 0.1% trifluoroacetic acid in 90% acetonitrile, 10% water. The column was pre-equilibrated in 10% solvent B at a flow rate of 80 μl per min. The protein was eluted using a linear gradient of 10% to 90% solvent B over 30 min. Part of the effluent was directed into a LCQ ion trap mass spectrometer. The mass spectrum was deconvoluted using the Bioworks software provided by the mass spectrometer manufacturer. (FIG. 76D). The product was filtered through a 0.22 μm cellulose acetate filter and then stored at −80° C.

In Table 35, IC50 data for the purified *E. coli*-derived ShK[2-35]-L-Fc are compared to some other embodiments of the inventive composition of matter.

TABLE 35

E. coli-derived recombinant Fc-L-ShK[1-35], Fc-L-ShK[2-35], Fc-L-OSK1, Shk[1-35]-L-Fc and ShK[2-35]-L-Fc peptibodies containing Fc at either the N-terminus or C-terminus show potent blockade of human Kv1.3. The activity of the CHO-derived Fc-L10-ShK[1-35] R1Q mutant is also shown. Whole cell patch clamp electrophysiology (WCVC), by methods described in Example 36, was performed using HEK293/Kv1.3 cells and the IC50 shown is the average from dose-response curves from 3 or more cells. IonWorks ™ (IWQ) planar patch clamp electrophysiology by methods described in Example 44 was on CHO/Kv1.3 cells and the average IC50 is shown. The inventive molecules were obtained by methods as described in the indicated Example: *E. coli*-derived Fc-L-ShK[1-35] (Example 3 and Example 38), *E. coli*-derived Fc-L-ShK[2-35] (Example 4 and Example 39), *E. coli* Fc-L-OSK1 (Example 10 and Example 40), ShK[1-35]-L-Fc (Example 15 and Example 51), and ShK[2-35]-L-Fc (Example 16 and this Example 50). CHO-derived Fc-L10-ShK[1-35] R1Q molecule was generated using methods similar to those described for CHO-derived Fc-L10-ShK[1-35].

| Molecule | Kv1.3 $IC_{50}$ by WCVC (nM) | Kv1.3 $IC_{50}$ by IWQ (nM) |
|---|---|---|
| *E. coli*-derived Fc-L-ShK[1-35] | 1.4 | |
| *E. coli*-derived Fc-L-ShK[2-35] | 1.3 | 2.8 |
| *E. coli*-derived Fc-L-OSK1 | 3.2 | |
| *E. coli*-derived Shk[1-35]-L-Fc | | 2.4 |
| *E. coli*-derived ShK[2-35]-L-Fc | | 4.9 |
| CHO-derived Fc-L10-ShK[1-35] R1Q | | 2.2 |

Example 51

Purification of Met-ShK(1-35)-Fc from *E. coli*

Frozen, *E. coli* paste (65 g), obtained as described in Example 15 herein above was combined with 660 ml of room temperature 50 mM tris HCl, 5 mM EDTA, pH 7.5 and was brought to about 0.1 mg/ml hen egg white lysozyme. The suspended paste was passed through a chilled microfluidizer twice at 12,000 PSI. The cell lysate was then centrifuged at 17,700 g for 30 min at 4° C. The pellet was then resuspended in 660 ml 1% deoxycholic acid using a tissue grinder and then centrifuged at 17,700 g for 30 min at 4° C. The pellet was then resuspended in 660 ml water using a tissue grinder and then centrifuged at 17,700 g for 30 min at 4° C. 13 g of the pellet was then dissolved in 130 ml 8 M guanidine HCl, 50 mM tris HCl, pH 8.0. 10 ml of the pellet solution was then incubated with 0.1 ml of 1 M DTT for 60 min at 37° C. The reduced material was transferred to 1000 ml of the refolding buffer (2 M urea, 50 mM tris, 160 mM arginine HCl, 2.5 mM EDTA, 1.2 mM cystamine HCl, 4 mM cysteine, pH 8.5) at 2 ml/min, 4° C. with vigorous stirring. The stirring rate was then slowed and the incubation was continued for 3 days at 4° C.

The refold was diluted with 1 L of water, and filtered through a 0.22 µm cellulose acetate filter then loaded on to a 35 ml Amersham Q Sepharose-FF (2.6 cm I.D.) column at 10 ml/min in Q-Buffer A (20 mM Tris, pH 8.5) at 8° C. with an inline 35 ml Amersham Mab Select column (2.6 cm I.D.). After loading, the Q Sepharose column was removed from the circuit, and the remaining chromatography was carried out on the Mab Select column. The column was washed with several column volumes of Q-Buffer A, followed by elution using a step to 100 mM glycine pH 3.0. The fractions containing the desired product immediately loaded on to a 5.0 ml Amersham SP-Sepharose HP column at 5.0 ml/min in S-Buffer A (20 mM $NaH_2PO_4$, pH 7.0) at 8° C. The column was then washed with several column volumes of S-Buffer A followed by a linear gradient from 5% to 60% S-Buffer B (20 mM $NaH_2PO_4$, 1 M NaCl, pH 7.0) followed by a step to 100% S-Buffer B. Fractions were then analyzed using a Coomassie brilliant blue stained tris-glycine 4-20% SDS-PAGE. The fractions containing the bulk of the desired product were pooled.

The S-pool was then concentrated to about 10 ml using a Pall Jumbo-Sep with a 10 kDa membrane. A spectral scan was then conducted on 20 µl of the combined pool diluted in 700 µl PBS using a Hewlett Packard 8453 spectrophotometer (FIG. 77A). Then concentration of the material was determined to be 3.1 mg/ml using a calculated molecular mass of 30,409 and extinction coefficient of 36,900 $M^{-1}$ $cm^{-1}$. The purity of the material was then assessed using a Coomassie brilliant blue stained tris-glycine 4-20% SDS-PAGE (FIG. 77B). The macromolecular state of the product was then determined using size exclusion chromatography on 93 µg of the product injected on to a Phenomenex BioSep SEC 3000 column (7.8×300 mm) in 50 mM $NaH_2PO_4$, 250 mM NaCl, pH 6.9 at 1 ml/min observing the absorbance at 280 nm (FIG. 77C). The product was then subject to mass spectral analysis by MALDI mass spectrometry. An aliquot of the sample was spotted with the MALDI matrix sinapinic acid on sample plate. A Voyager DE-RP time-of-flight mass spectrometer equipped with a nitrogen laser (337 nm, 3 ns pulse) was used to collect spectra. The positive ion/linear mode was used, with an accelerating voltage of 25 kV. Each spectrum was produced by accumulating data from ~200 laser shots (FIG. 77D). External mass calibration was accomplished using purified proteins of known molecular masses.

The $IC_{50}$ for blockade of human Kv1.3 by purified *E. coli*-derived Met-ShK(1-35)-Fc, also referred to as "ShK[1-35]-L-Fc", is shown in Table 35 herein above.

Example 52

Bacterial Expression of OsK1-L-Fc Inhibitor of Kv1.3

The methods to clone and express the peptibody in bacteria were as described in Example 3. The vector used was pAMG21amgR-pep-Fc and the oligos listed below were used to generate a duplex (see below) for cloning and expression in bacteria of OsK1-L-Fc.

Oligos used to form duplex are shown below:

```
GGGTGTTATCATCAACGTTAAATGCAAAATCTCCCGTCAGTGCCTGGAACCGTGCAAAAAAGCTGGTATGCGT; //SEQ ID NO: 1347

TTCGGTAAATCCATGAACGGTAAATGCCACTGCACCCCGAAATCTGGTGGTGGTGGTTCT;            //SEQ ID NO: 1348
```

```
CACCAGAACCACCACCACCACCAGATTTCGGGGTGCAGTGGCATTTACCGTTCATGCATTTACCGAAACGCAT;    //SEQ ID NO:
                                                                               1349

ACCAGCTTTTTTGCACGGTTCCAGGCACTGACGGGAGATTTTGCATTTAACGTTGATGATAAC;              //SEQ ID NO:
                                                                               1310
```

The oligos shown above were used to form the duplex shown below:

```
    GGGTGTTATCATCAACGTTAAATGCAAAATCTCCCGTCAGTGCCTGGAACCGTGCAAAAA          //SEQ ID NO: 1350
1---------+---------+---------+---------+---------+---------+     60
      CAATAGTAGTTGCAATTTACGTTTTAGAGGGCAGTCACGGACCTTGGCACCTTTTT           //SEQ ID NO: 1352
    G  V  I  I  N  V  K  C  K  I  S  R  Q  C  L  E  P  C  K  K     -     //SEQ ID NO: 1351

AGCTGGTATGCGTTTCGGTAAATGCATGAACGGTAAATGCCACTGCACCCCGAAATCTGG
61---------+---------+---------+---------+---------+---------+    120
    TCGACCATACGCAAAGCCATTTACGTACTTGCCATTTACGGTGACGTGGGGCTTTAGACC
    A  G  M  R  F  G  K  C  M  N  G  K  C  H  C  T  P  K  S  G    -

TGGTGGTGGTTCT
121---------+-------                                               137
    ACCACCACCAAGACCAC
    G  G  G  S  G                                                  -
```

Bacterial expression of the peptibody was as described in Example 3 and paste was stored frozen.

Example 53

Bacterial Expression of Gly-ShK(1-35)-L-Fc Inhibitor of Kv1.3

The methods to clone and express the peptibody in bacteria were as described in Example 3. The vector used was pAMG21amgR-pep-Fc and the oligos listed below were used to generate a duplex (see below) for cloning and expression in bacteria of Gly-ShK(1-35)-L-Fc. Oligos used to form duplex are shown below:

```
GGGTCGTTCTTGTATTGATACTATTCCAAAATCTCGTTGTACTGCTTTTCAATGTAAACATTCTA    //SEQ ID NO: 1313
TGAAATATCGTCTTTCTT;

TTTGTCGTAAAACTTGTGGTACTTGTTCTGGTGGTGGTTCT;                            //SEQ ID NO: 1314

CACCAGAACCACCACCACCAGAACAAGTACCACAAGTTTTACGACAAAAAGAAAGACGATATTT     //SEQ ID NO: 1353
CATAGAATGTTTACATTGA;

AAAGCAGTACAACGAGATTTTGGAATAGTATCAATACAAGAACG                         //SEQ ID NO: 1354
```

The oligos shown above were used to form the duplex shown below:

```
    GGGTCGTTCTTGTATTCATACTATTCCAAAATCTCGTTGTACTGCTTTTCAATGTAAACA        //SEQ ID NO: 1355
1---------+---------+---------+---------+---------+---------+     60
        GCAAGAACATAACTATGATAAGGTTTTAGAGCAACATGACGAAAAGTTACATTTGT        //SEQ ID NO: 1357
    G  R  S  C  I  D  T  I  P  K-                                 -    //SEQ ID NO: 1356
        S  R  C  T  A  F  Q  C  K  H

TTCTATGAAATATCGTCTTTCTTTTTGTCGTAAAACTTGTGGTACTTGTTCTGGTGGTGG
61---------+---------+---------+---------+---------+---------+   120
    AAGATACTTTATAGCAGAAAGAAAAACAGCATTTTGAACACCATGAACAAGACCACCACC
    S  M  K  Y  R  L  S  F  C  R  K  T  C  G  T  C  S  G  G      -

TGGTTCT
121---------+-                                                   131
    ACCAAGACCAC
    G  S  G                                                      -
```

Abbreviations

Abbreviations used throughout this specification are as defined below, unless otherwise defined in specific circumstances.

Ac acetyl (used to refer to acetylated residues)
AcBpa acetylated p-benzoyl-L-phenylalanine
ADCC antibody-dependent cellular cytotoxicity
Aib aminoisobutyric acid
bA beta-alanine
Bpa p-benzoyl-L-phenylalanine
BrAc bromoacetyl (BrCH$_2$C(O)
BSA Bovine serum albumin
Bzl Benzyl
Cap Caproic acid COPD Chronic obstructive pulmonary disease
CTL Cytotoxic T lymphocytes
DCC Dicylcohexylcarbodiimide
Dde 1-(4,4-dimethyl-2,6-dioxo-cyclohexylidene)ethyl
ESI-MS Electron spray ionization mass spectrometry
Fmoc fluorenylmethoxycarbonyl
HOBt 1-Hydroxybenzotriazole
HPLC high performance liquid chromatography
HSL homoserine lactone
IB inclusion bodies
KCa calcium-activated potassium channel (including IKCa, BKCa, SKCa)
Kv voltage-gated potassium channel
Lau Lauric acid
LPS lipopolysaccharide
LYMPH lymphocytes
MALDI-MS Matrix-assisted laser desorption ionization mass spectrometry
Me methyl
MeO methoxy
MHC major histocompatibility complex
MMP matrix metalloproteinase
1-Nap 1-napthylalanine
NEUT neutrophils
Nle norleucine
NMP N-methyl-2-pyrrolidinone
PAGE polyacrylamide gel electrophoresis
PBMC peripheral blood mononuclear cell
PBS Phosphate-buffered saline
Pbf 2,2,4,6,7-pendamethyldihydrobenzofuran-5-sulfonyl
PCR polymerase chain reaction
Pec pipecolic acid
PEG Poly(ethylene glycol)
pGlu pyroglutamic acid
Pic picolinic acid
pY phosphotyrosine
RBS ribosome binding site
RT room temperature (25° C.)
Sar sarcosine
SDS sodium dodecyl sulfate
STK serine-threonine kinases
t-Boc tert-Butoxycarbonyl
tBu tert-Butyl
THF thymic humoral factor
Trt trityl

SEQUENCE LISTING (1390 sequences)

SEQ ID NO: 1 - DNA, 738 bp, Homo sapiens
  CDS (1)..(738)
atggaatggagctgggtctttctcttcttcctgtcagtaacgactggtgtccactccgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2 - protein, 246 aa, Homo sapiens
MEWSWVFLFFLSVTTGVHSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3 - DNA, 684 bp, Homo sapiens
  CDS (1)..(684)
atggacaaaactcacacatgtccaccttgtccagctccggaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 4 - protein, 228 aa, Homo sapiens
MDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5 - protein, 35 aa, Stichodactyla helianthus
RSCIDTIPKSRCTAFQCKHSMKYRLSFCRKTCGTC

SEQ ID NO: 6 - protein, 35 aa, Heteractis magnifica
RTCKDLIPVSECTDIRCRTSMKYRLNLCRKTCGSC

SEQ ID NO: 7 - protein, 36 aa, Actinia equina
GCKDNFSANTCKHVKANNNCGSQKYATNCAKTCGKC

SEQ ID NO: 8 - protein, 36 aa, Anemonia sulcata
ACKDNFAAATCKHVKENKNCGSQKYATNCAKTCGKC

SEQ ID NO: 9 - protein, 37 aa, Bunodosoma granulifera
VCRDWFKETACRHAKSLGNCRTSQKYRANCAKTCELC

SEQ ID NO: 10 - protein, 35 aa, Artificial Sequence; identical to SEQ ID NO: 5
  ShK peptide sequence
  MISC_FEATURE: Amino acid alignment of ShK to other members of the sea anemone family of toxins. Disulfide linkages are found between positions 3-35, 12-28, and 17-32.

SEQ ID NO: 11 - protein, 54 aa, Artificial Sequence
  BmKK1-precursor
MKIFFAILLILAVCSMAIWTVNGTPFAIKCATDADCSRKCPGNPSCRNGFCACT

SEQ ID NO: 12 - protein, 55 aa, Artificial Sequence
  BmKK4-precursor
MKFIIVLILISVLIATIVPVNEAQTQCQSVRDCQQYCLTPDRCSYGTCYCKTTGK

SEQ ID NO: 13 - protein, 35 aa, Artificial Sequence
  Kvt1.3 peptide inhibitor sequence - Tc32
TGPQTTCQAAMCEAGCKGLGKSMESCQGDTCKCKA

SEQ ID NO: 14 - protein, 37 aa, Artificial Sequence
  PBTx1
DEEPKESCSDEMCVIYCKGEEYSTGVCDGPQKCKCSD

SEQ ID NO: 15 - protein, 56 aa, Artificial Sequence
  BmKK6-precursor
MSRLFTLVLIVLAMNVMMAIISDPVVEAVGCEECPMHCKGKNAKPTCDDGVCNCNV

SEQ ID NO: 16 - protein, 29 aa, Artificial Sequence
  SKCa peptide inhibitor sequence - P01
VSCEDCPEHCSTQKAQAKCDNDKCVCEPI

SEQ ID NO: 17 - protein, 35 aa, Artificial Sequence
  Kv1.3 peptide inhibitor sequence - Pi2
TISCTNPKQCYPHCKKETGYPNAKCMNRKCKCFGR

SEQ ID NO: 18 - protein, 35 aa, Artificial Sequence
  Kv1.3 peptide inhibitor sequence - Pi3
TISCTNEKQCYPHCKKETGYPNAKCMNRKCKCFGR

SEQ ID NO: 19 - protein, 38 aa, Artificial Sequence
  Kv1.3 peptide inhibitor sequence - Pi4
IEAIRCGGSRDCYRPCQKRTGCPNAKCINKTCKCYGCS

SEQ ID NO: 20 - protein, 34 aa, Artificial Sequence
  IKCa1 peptide inhibitor sequence - MTX
VSCTGSKDCYAPCRKQTGCPNAKCINKSCKCYGC

SEQ ID NO: 21 - protein, 35 aa, Artificial Sequence
  Kv1.3 peptide inhibitor sequence - Pi1
LVKCRGTSDCGRPCQQQTGCPNSKCINRMCKCYGC

SEQ ID NO: 22 - protein, 60 aa, Artificial Sequence
  BmKTX-precursor
MKVFFAVLITLFICSMIIGIHGVGINVKCKHSGQCLKPCKDAGMRFGKCINGKCDCTPKG

SEQ ID NO: 23 - protein, 38 aa, Artificial Sequence
  Kv1.3 peptide inhibitor sequence - AgTx2
GVPINVSCTGSPQCIKPCKDAGMRFGKCMNRKCHCTPK

SEQ ID NO: 24 - protein, 38 aa, Artificial Sequence
  Kaliotoxin 1 (KTX1) peptide sequence
GVEINVKCSGSPQCLKPCKDAGMRFGKCMNRKCHCTPK

SEQ ID NO: 25 - protein, 38 aa, Artificial Sequence
  Kv1.3 peptide inhibitor sequence - OSK1
GVIINVKCKISRQCLEPCKKAGMRFGKCMNGKCHCTPK

SEQ ID NO: 26 - protein, 38 aa, Artificial Sequence
  Kvt1.3 peptide inhibitor sequence - BmKTX
VGINVKCKHSGQCLKPCKDAGMRFGKCINGKCDCTPKG

SEQ ID NO: 27 - protein, 39 aa, Artificial Sequence
  Kvt1.3 peptide inhibitor sequence - HgTx1
TVIDVKCTSPKQCLPPCKAQFGIRAGAKCMNGKCKCYPH

SEQ ID NO: 28 - protein, 39 aa, Artificial Sequence
  MgTx peptide sequence - MgTx
TIINVKCTSPKQCLPPCKAQFGQSAGAKCMNGKCKCYPH

SEQ ID NO: 29 - protein, 38 aa, Artificial Sequence
  BKCa peptide inhibitor sequence - BllTx1
ITINVKCTSPQQCLRPCKDRFGQHAGGKCINGKCKCYP

SEQ ID NO: 30 - protein, 39 aa, Artificial Sequence
  Noxiustoxin peptide sequence - NTX
TIINVKCTSPKQCSKPCKELYGSSAGAKCMNGKCKCYNN

SEQ ID NO: 31 - protein, 37 aa, Artificial Sequence
  Tc30
VFINVKCRGSKECLPACKAAVGKAAGKCMNGKCKCYP

SEQ ID NO: 32 - protein, 37 aa, Artificial Sequence
  TsTX-Ka
VFINAKCRGSPECLPKCKEAIGKAAGKCMNGKCKCYP

SEQ ID NO: 33 - protein, 37 aa, Artificial Sequence
  PBTx3
EVDMRCKSSKECLVKCKQATGRPNGKCMNRKCKCYPR

SEQ ID NO: 34 - protein, 36 aa, Artificial Sequence
  Lgh 15-1
GLIDVRCYDSRQCWIACKKVTGSTQGKCQNKQCRCY

SEQ ID NO: 35 - protein, 37 aa, Artificial Sequence
  BKCa peptide inhibitor sequence - MartenTx
FGLIDVKCFASSECWTACKKVTGSGQGKCQNNQCRCY

SEQ ID NO: 36 - protein, 37 aa, Artificial Sequence
  Kvt1.3 peptide inhibitor sequence - ChTx
QFTNVSCTTSKECWSVCQRLHNTSRGKCMNKKCRCYS

SEQ ID NO: 37 - protein, 59 aa, Artificial Sequence
  MartenTx-precursor
MKIFSILLVALIICSISICTEAFGLIDVKCFASSECWTACKKVTGSGQGKCQNNQCRCY

SEQ ID NO: 38 - protein, 37 aa, Artificial Sequence
  BKCa peptide inhibitor sequence - IbTx
QFTDVDCSVSKECWSVCKDLFGVDRGKCMGKKCRCYQ

SEQ ID NO: 39 - protein, 37 aa, Artificial Sequence
  BKCa peptide inhibitor sequence - Slotoxin (SloTx)
TFIDVDCTVSKECWAPCKAAFGVDRGKCMGKKCKCYV

SEQ ID NO: 40 - protein, 37 aa, Artificial Sequence
  Kvt1.3 peptide inhibitor sequence - BmTx1
QFTDVKCTGSKQCWPVCKQMFGKPNGKCMNGKCRCYS

SEQ ID NO: 41 - protein, 41 aa, Artificial Sequence
  BKCa peptide inhibitor sequence - BuTx
WCSTCLDLACGASRECYDPCFKAFGRAHGKCMNNKCRCYTN

SEQ ID NO: 42 - protein, 59 aa, Artificial Sequence
  ChTx-Lg2
MKILSVLLLALIICSIVGWSEAQFTNVSCTTSKECWSVCQRLHNTSRGKCMNKKCRCYS

SEQ ID NO: 43 - protein, 57 aa, Artificial Sequence
  BmTx1-precursor
MKISFLLLALVICSIGWSEAQFTDVKCTGSKQCWPVCKQMFGKPNGKCMNGKCRCYS

SEQ ID NO: 44 - protein, 37 aa, Artificial Sequence
  AmmTX3
QIETNKKCQGGSCASVCRKVIGVAAGKCINGRCVCYP

SEQ ID NO: 45 - protein, 59 aa, Artificial Sequence
  AaTX1
MKFSSIILLTLLICSMSIFGNCQIETNKKCQGGSCASVCRRVIGVAAGKCINGRCVCYP

SEQ ID NO: 46 - protein, 59 aa, Artificial Sequence
  BmTX3
MKFSSIILLTLLICSMSKFGNCQVETNVKCQGGSCASVCRKAIGVAAGKCINGRCVCYP

SEQ ID NO: 47 - protein, 35 aa, Artificial Sequence
  SKCa peptide inhibitor sequence - TsK
VVIGQRCYRSPDCYSACKKLVGKATGKCTNGRCDC

SEQ ID NO: 48 - protein, 23 aa, Artificial Sequence
  Tc1
ACGSCRKKCKGSGKCINGRCKCY

SEQ ID NO: 49 - protein, 28 aa, Artificial Sequence
  OSK2
ACGPGCSGSCRQKGDRIKCINGSCHCYP

SEQ ID NO: 50 - protein, 32 aa, Artificial Sequence
  SKCa peptide inhibitor sequence - BmP05
AVCNLKRCQLSCRSLGLLGKCIGDKCECVKHG

SEQ ID NO: 51 - protein, 31 aa, Artificial Sequence
  SKCa peptide inhibitor sequence - ScyTx
AFCNLRMCQLSCRSLGLLGKCIGDKCECVKH

SEQ ID NO: 52 - protein, 31 aa, Artificial Sequence
  SKCa peptide inhibitor sequence - P05
TVCNLRRCQLSCRSLGLLGKCIGVKCECVKH

SEQ ID NO: 53 - protein, 31 aa, Artificial Sequence
  SKCa peptide inhibitor sequence - Tamapin
AFCNLRRCELSCRSLGLLGKCIGEECKCVPY

SEQ ID NO: 54 - protein, 57 aa, Artificial Sequence
  TsK-precursor
MKVLYGILIIFILCSMFYLSQEVVIGQRCYRSPDCYSACKKLVGKATGKCTNGRCDC

SEQ ID NO: 55 - protein, 62 aa, Artificial Sequence
  CoTx1
MEGIAKITLILLFLFVTMHTFANWNTEAAVCVYRTCDKDCKRRGYRSGKCINNACKCYPYGK

SEQ ID NO: 56 - protein, 35 aa, Artificial Sequence
  T type Ca channel peptide inhibitor sequence - ProTx1
ECRYWLGGCSAGQTCCKHLVCSRRHGWCVWDGTFS

SEQ ID NO: 57 - protein, 31 aa, Artificial Sequence
  Kv4.3 & Kv4.2 peptide inhibitor sequence - PaTx2
YCQKWMWTCDEERKCCEGLVCRLWCKRIINM

SEQ ID NO: 58 - protein, 34 aa, Artificial Sequence
  Folded Des-Arg1-ShK.
  DISULFID (2)..(34): Folded Des-Arg1-Shk with disulfide bonds between 2-34, 51-67, and 56-71.
  DISULFID (11)..(27): Folded Des-Arg1-Shk with disulfide bonds between 2-34, 11-27, and 16-31.
  DISULFID (16)..(31): Folded Des-Arg1-Shk with disulfide bonds between 2-34, 11-27, and 16-31.
SCIDTIPKSRCTAFQCKHSMKYRLSFCRKTCGTC

SEQ ID NO: 59 - protein, 37 aa, Artificial Sequence
  Charybdotoxin (ChTx)peptide sequence - ChTx-E32
QFTNVSCTTSKECWSVCQRLHNTSRGKCMNKECRCYS

SEQ ID NO: 60 - protein, 61 aa, Artificial Sequence
  BmPo5-precursor
MHNYYKIVLIMVAFFAVIITFSNIQVEGAVCNLKRCQLSCRSLGLLGKCIGDKCECVKHGK

SEQ ID NO: 61 - protein, 34 aa, Artificial Sequence
  Heteromitrus spinnifer peptide sequence - HsTx1.
ASCRTPKDCADPCRKETGCPYGKCMNRKCKCNRC

SEQ ID NO: 62 - protein, 35 aa, Artificial Sequence
  Kv1.3 peptide inhibitor sequence - Anuroctoxin
ZKECTGPQHCTNFCRKNKCTHGKCMNRKCKCFNCK

SEQ ID NO: 63 - protein, 36 aa, Artificial Sequence
  M current peptide inhibitor sequence - BeKm1
RPTDIKCSESYQCFPVCKSRFGKTNGRCVNGFCDCF

SEQ ID NO: 64 - protein, 27 aa, Artificial Sequence
  N type Ca channel peptide inhibitor sequence - GVIA
CKSPGSSCSPTSYNCCRSCNPYTKRCY

SEQ ID NO: 65 - protein, 25 aa, Artificial Sequence
  N type Ca channel peptide inhibitor sequence - MVIIA
CKGKGAKCSRLMYDCCTGSCRSGKC

SEQ ID NO: 66 - protein, 34 aa, Artificial Sequence
  N type Ca channel peptide inhibitor sequence - Ptu1
AEKDCIAPGAPCFGTDKPCCNPRAWCSSYANKCL

SEQ ID NO: 67 - protein, 36 aa, Artificial Sequence
  CI channel peptide inhibitor sequence - CTX
MCMPCFTTDHQMARKCDDCCGGKGRGKCYGPQCLCR

SEQ ID NO: 68 - protein, 19 aa, Artificial Sequence
  SKCa peptide inhibitor sequence - Apamin
CNCKAPETALCARRCQQHG

SEQ ID NO: 69 - DNA, 720 bp, Artificial Sequence
  Nucleic acid and amino acid sequences of pAMG21ampR-Fc-pep
  CDS (4)..(702)
catatggacaaaactcacacatgtccaccttgtccagctccggaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggtggaggtggtggttgagacgctgcaggacgt

SEQ ID NO: 70 - protein, 233 aa, Artificial Sequence
  Synthetic Construct
MDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGG

SEQ ID NO: 71 - DNA, 687 bp, Artificial Sequence
  Nucleic acid and amino acid sequences of pAMG21ampR-Fc-pep.  Fc domain sequences exclude the five C-terminal glycine residues.
  CDS (4)..(687)
catatggacaaaactcacacatgtccaccttgtccagctccggaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 72 - protein, 228 aa, Artificial Sequence; identical to SEQ ID NO: 4
  Synthetic Construct

SEQ ID NO: 73 - DNA, 709 bp, Artificial Sequence
  Nucleic acid and amino acid sequences of pAMG21ampR-Pep-Fc.
  CDS (4)..(699)
tcaggtggtggtggtggtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaataatggatcc

SEQ ID NO: 74 - protein, 232 aa, Artificial Sequence
  Synthetic Construct
GGGGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 75 - DNA, 691 bp, Artificial Sequence
  Nucleic acid and amino acid sequences of pAMG21ampR-Pep-Fc.  The Fc domain sequences exclude the five N-terminal glycine residues.
  CDS (1)..(681)
gacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaataatggatcc

SEQ ID NO: 76 - protein, 227 aa, Artificial Sequence
  Synthetic Construct
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 77 - DNA, 879 bp, Artificial Sequence
  Nucleotide and amino acid sequences of molecule Fc-L10-ShK [1-35].
  CDS (1)..(879)
atggaatggagctgggtctttctcttcttcctgtcagtaacgactggtgtccactccgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggaggaggaggatccggaggaggaggaagccgcagctgcatcgacaccatccccaagagccgctgcaccgccttccagtgcaagcacagcatgaagtaccgcctgagcttctgccgcaagacctgcggcacctgctaatga

SEQ ID NO: 78 - protein, 291 aa, Artificial Sequence
  Synthetic Construct
MEWSWVFLFFLSVTTGVHSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSRSCIDTIPKSRCTAFQCKHSMKYRLSFCRKTCGTC

SEQ ID NO: 79 - protein, 10 aa, Artificial Sequence
  L10 linker amino acid sequence used in Fc-L10-ShK [1-35].
GGGGSGGGGS

SEQ ID NO: 80 - DNA, 873 bp, Artificial Sequence
  Nucleotide and amino acid sequences of molecule Fc-L10-ShK [2-35].
  CDS (1)..(873)
atggaatggagctgggtctttctcttcttcctgtcagtaacgactggtgtccactccgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggaggaggaggatccggaggaggaggaagcagctgcatcgacaccatccccaagagccgctgcaccgccttccagtgcaagcacagcatgaagtaccgcctgagcttctgccgcaagacctgcggcacctgctaa

SEQ ID NO: 81 - protein, 290 aa, Artificial Sequence
  Synthetic Construct
MEWSWVFLFFLSVTTGVHSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSSCIDTIPKSRCTAFQCKHSMKYRLSFCRKTCGTC

SEQ ID NO: 82 - DNA, 918 bp, Artificial Sequence
  Nucleotide and amino acid sequences of molecule Fc-L25-ShK [2-35].
  CDS (1)..(918)
atggaatggagctgggtctttctcttcttcctgtcagtaacgactggtgtccactccgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggaggaggaggatccgggggtgggggttctgggggtgggggttctggaggaggaggaagcggaggaggaggaagcagctgcatcgacaccatccccaagagccgctgcaccgccttccagtgcaagcacagcatgaagtaccgcctgagcttctgccgcaagacctgcggcacctgctaa

SEQ ID NO: 83 - protein, 305 aa, Artificial Sequence
  Synthetic Construct
MEWSWVFLFFLSVTTGVHSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSSCIDTIPKSRCTAFQCKHSMKYRLSFCRKTCGTC

SEQ ID NO: 84 - protein, 25 aa, Artificial Sequence
  L-25 linker amino acid sequence used in Fc-L25-ShK [2-35].
GGGGSGGGGSGGGGSGGGGSGGGGS

SEQ ID NO: 85 - protein, 38 aa, Artificial Sequence
  Kv1.3 peptide inhibitor sequence - AgTx1
GVPINVKCTGSPQCLKPCKDAGMRFGKCINGKCHCTPK

SEQ ID NO: 86 - protein, 37 aa, Artificial Sequence; identical to SEQ ID NO: 32
  Kvt1.3 peptide inhibitor sequence - Titystoxin-Ka

SEQ ID NO: 87 - protein, 37 aa, Artificial Sequence; identical to SEQ ID NO: 31
  Kvt1.3 peptide inhibitor sequence - Tc30

SEQ ID NO: 88 - protein, 35 aa, Artificial Sequence
  ShK peptide sequence - ShK-S17/S32
RSCIDTIPKSRCTAFQSKHSMKYRLSFCRKTSGTC

SEQ ID NO: 89 - protein, 35 aa, Artificial Sequence
  ShK peptide sequence - ShK-S3/S35
RSSIDTIPKSRCTAFQCKHSMKYRLSFCRKTCGTS

SEQ ID NO: 90 - protein, 35 aa, Artificial Sequence
  ShK peptide sequence - ShK-S1
SSCIDTIPKSRCTAFQCKHSMKYRLSFCRKTCGTC

SEQ ID NO: 91 - protein, 35 aa, Artificial Sequence
  ShK peptide sequence - ShK-N-acetylarg1
  MISC_FEATURE (1)..(1): N-acetylarginine
XSCIDTIPKSRCTAFQCKHSMKYRLSFCRKTCGTC

SEQ ID NO: 92 - protein, 34 aa, Artificial Sequence; identical to SEQ ID NO: 58
  ShK peptide sequence - ShK-d1

SEQ ID NO: 93 - protein, 33 aa, Artificial Sequence
  ShK peptide sequence - ShK-d2
CIDTIPKSRCTAFQCKHSMKYRLSFCRKTCGTC

SEQ ID NO: 94 - protein, 35 aa, Artificial Sequence
  ShK peptide sequence - ShK-A1
ASCIDTIPKSRCTAFQCKHSMKYRLSFCRKTCGTC

SEQ ID NO: 95 - protein, 35 aa, Artificial Sequence
  ShK peptide sequence - ShK-A4
RSCADTIPKSRCTAFQCKHSMKYRLSFCRKTCGTC

SEQ ID NO: 96 - protein, 35 aa, Artificial Sequence
  ShK peptide sequence - ShK-A4/A15
RSCADTIPKSRCTAAQCKHSMKYRLSFCRKTCGTC

SEQ ID NO: 97 - protein, 35 aa, Artificial Sequence
  ShK peptide sequence - ShK-A4/A15/A25
RSCADTIPKSRCTAAQCKHSMKYRASFCRKTCGTC

SEQ ID NO: 98 - protein, 35 aa, Artificial Sequence
  ShK peptide sequence - ShK-A6
RSCIDAIPKSRCTAFQCKHSMKYRLSFCRKTCGTC

SEQ ID NO: 99 - protein, 35 aa, Artificial Sequence
  ShK peptide sequence - ShK-A7
RSCIDTAPKSRCTAFQCKHSMKYRLSFCRKTCGTC

SEQ ID NO: 100 - protein, 35 aa, Artificial Sequence
  ShK peptide sequence - Shk-A8
RSCIDTIAKSRCTAFQCKHSMKYRLSFCRKTCGTC

SEQ ID NO: 101 - protein, 35 aa, Artificial Sequence
  ShK peptide sequence - ShK-A9
RSCIDTIPASRCTAFQCKHSMKYRLSFCRKTCGTC

SEQ ID NO: 102 - protein, 35 aa, Artificial Sequence
  ShK peptide sequence - ShK-E9
RSCIDTIPESRCTAFQCKHSMKYRLSFCRKTCGTC

SEQ ID NO: 103 - protein, 35 aa, Artificial Sequence
  ShK peptide sequence - ShK-Q9
RSCIDTIPQSRCTAFQCKHSMKYRLSFCRKTCGTC

SEQ ID NO: 104 - protein, 35 aa, Artificial Sequence
  ShK peptide sequence - ShK-A10
RSCIDTIPKARCTAFQCKHSMKYRLSFCRKTCGTC

SEQ ID NO: 105 - protein, 35 aa, Artificial Sequence
  ShK peptide sequence - ShK-A11
RSCIDTIPKSACTAFQCKHSMKYRLSFCRKTCGTC

SEQ ID NO: 106 - protein, 35 aa, Artificial Sequence
  ShK peptide sequence - ShK-E11
RSCIDTIPKSECTAFQCKHSMKYRLSFCRKTCGTC

SEQ ID NO: 107 - protein, 35 aa, Artificial Sequence
  ShK peptide sequence - ShK-Q11
RSCIDTIPKSQCTAFQCKHSMKYRLSFCRKTCGTC

SEQ ID NO: 108 - protein, 35 aa, Artificial Sequence
  ShK peptide sequence - ShK-A13
RSCIDTIPKSRCAAFQCKHSMKYRLSFCRKTCGTC

SEQ ID NO: 109 - protein, 35 aa, Artificial Sequence
  ShK peptide sequence - ShK-A15
RSCIDTIPKSRCTAAQCKHSMKYRLSFCRKTCGTC

SEQ ID NO: 110 - protein, 35 aa, Artificial Sequence
  ShK peptide sequence - ShK-W15
RSCIDTIPKSRCTAWQCKHSMKYRLSFCRKTCGTC

SEQ ID NO: 111 - protein, 35 aa, Artificial Sequence
  ShK peptide sequence - ShK-X15
  MISC_FEATURE (15)..(15): Any nonfunctional amino acid residue
RSCIDTIPKSRCTAXQCKHSMKYRLSFCRKTCGTC

SEQ ID NO: 112 - protein, 35 aa, Artificial Sequence
  ShK peptide sequence - ShK-A15/A25
RSCIDTIPKSRCTAAQCKHSMKYRASFCRKTCGTC

SEQ ID NO: 113 - protein, 35 aa, Artificial Sequence
  ShK peptide sequence - ShK-A16
RSCIDTIPKSRCTAFACKHSMKYRLSFCRKTCGTC

SEQ ID NO: 114 - protein, 35 aa, Artificial Sequence
  ShK peptide sequence - ShK-E16
RSCIDTIPKSRCTAFECKHSMKYRLSFCRKTCGTC

SEQ ID NO: 115 - protein, 35 aa, Artificial Sequence
  ShK peptide sequence - ShK-A18
RSCIDTIPKSRCTAFQCAHSMKYRLSFCRKTCGTC

SEQ ID NO: 116 - protein, 35 aa, Artificial Sequence
  ShK peptide sequence - ShK-E18
RSCIDTIPKSRCTAFQCEHSMKYRLSFCRKTCGTC

SEQ ID NO: 117 - protein, 35 aa, Artificial Sequence
  ShK peptide sequence - ShK-A19
RSCIDTIPKSRCTAFQCKASMKYRLSFCRKTCGTC

SEQ ID NO: 118 - protein, 35 aa, Artificial Sequence
  ShK peptide sequence - ShK-K19
RSCIDTIPKSRCTAFQCKKSMKYRLSFCRKTCGTC

SEQ ID NO: 119 - protein, 35 aa, Artificial Sequence
  ShK peptide sequence - ShK-A20
RSCIDTIPKSRCTAFQCKHAMKYRLSFCRKTCGTC

SEQ ID NO: 120 - protein, 35 aa, Artificial Sequence
  ShK peptide sequence - ShK-A21
RSCIDTIPKSRCTAFQCKHSAKYRLSFCRKTCGTC

SEQ ID NO: 121 - protein, 35 aa, Artificial Sequence
  ShK peptide sequence - ShK-X21
  MISC_FEATURE (21)..(21): Any nonfunctional amino acid residue.
RSCIDTIPKSRCTAFQCKHSXKYRLSFCRKTCGTC

SEQ ID NO: 122 - protein, 35 aa, Artificial Sequence; identical to SEQ ID NO: 121
  ShK peptide sequence - ShK-Nle21
  MISC_FEATURE (21)..(21): Xaa is norleucine.

SEQ ID NO: 123 - protein, 35 aa, Artificial Sequence
  ShK peptide sequence - ShK-A22
RSCIDTIPKSRCTAFQCKHSMAYRLSFCRKTCGTC

SEQ ID NO: 124 - protein, 35 aa, Artificial Sequence
  ShK peptide sequence - ShK-E22
RSCIDTIPKSRCTAFQCKHSMEYRLSFCRKTCGTC

SEQ ID NO: 125 - protein, 35 aa, Artificial Sequence
  ShK peptide sequence - ShK-R22
RSCIDTIPKSRCTAFQCKHSMRYRLSFCRKTCGTC

SEQ ID NO: 126 - protein, 35 aa, Artificial Sequence
  ShK peptide sequence - ShK-X22
  MISC_FEATURE (22)..(22): Any nonfunctional amino acid residue
RSCIDTIPKSRCTAFQCKHSMXYRLSFCRKTCGTC

SEQ ID NO: 127 - protein, 35 aa, Artificial Sequence; identical to SEQ ID NO: 126
  ShK peptide sequence - ShK-Nle22
  MISC_FEATURE (22)..(22): Xaa is Norleucine.

SEQ ID NO: 128 - protein, 35 aa, Artificial Sequence; identical to SEQ ID NO: 126
  ShK peptide sequence - ShK-Orn22
  MISC_FEATURE (22)..(22): Xaa is Ornithine.

SEQ ID NO: 129 - protein, 35 aa, Artificial Sequence; identical to SEQ ID NO: 126
  ShK peptide sequence - ShK-Homocit22
  MISC_FEATURE (22)..(22): Xaa is homocitrulline.

SEQ ID NO: 130 - protein, 35 aa, Artificial Sequence; identical to SEQ ID NO: 126
  ShK peptide sequence - ShK-Diaminopropionic22
  MISC_FEATURE (22)..(22): Xaa is diaminopropionic acid.

SEQ ID NO: 131 - protein, 35 aa, Artificial Sequence
  ShK peptide sequence - ShK-A23
RSCIDTIPKSRCTAFQCKHSMKARLSFCRKTCGTC

SEQ ID NO: 132 - protein, 35 aa, Artificial Sequence
  ShK peptide sequence - ShK-S23
RSCIDTIPKSRCTAFQCKHSMKSRLSFCRKTCGTC

SEQ ID NO: 133 - protein, 35 aa, Artificial Sequence
  ShK peptide sequence - ShK-F23
RSCIDTIPKSRCTAFQCKHSMKFRLSFCRKTCGTC

SEQ ID NO: 134 - protein, 35 aa, Artificial Sequence
  ShK peptide sequence - ShK-X23
  MISC_FEATURE (23)..(23): Any nonfunctional amino acid residue.
RSCIDTIPKSRCTAFQCKHSMKXRLSFCRKTCGTC

SEQ ID NO: 135 - protein, 35 aa, Artificial Sequence; identical to SEQ ID NO: 134
  ShK peptide sequence - ShK-Nitrophe23
  MISC_FEATURE (23)..(23): Nitrophenylalanine

SEQ ID NO: 136 - protein, 35 aa, Artificial Sequence; identical to SEQ ID NO: 134
  ShK peptide sequence - ShK-aminopheala23
  MISC_FEATURE (23)..(23): Xaa is aminophenylalanine.

SEQ ID NO: 137 - protein, 35 aa, Artificial Sequence; identical to SEQ ID NO: 134
  ShK peptide sequence -ShK-Benzoylpheala23
  MISC_FEATURE (23)..(23): Xaa is benzoylphenylalanine.

SEQ ID NO: 138 - protein, 35 aa, Artificial Sequence
  ShK peptide sequence - ShK-A24
RSCIDTIPKSRCTAFQCKHSMKYALSFCRKTCGTC

SEQ ID NO: 139 - protein, 35 aa, Artificial Sequence
  ShK peptide sequence - ShK-E24
RSCIDTIPKSRCTAFQCKHSMKYELSFCRKTCGTC

SEQ ID NO: 140 - protein, 35 aa, Artificial Sequence
  ShK peptide sequence - ShK-A25
RSCIDTIPKSRCTAFQCKHSMKYRASFCRKTCGTC

SEQ ID NO: 141 - protein, 35 aa, Artificial Sequence
  ShK peptide sequence - ShK-A26
RSCIDTIPKSRCTAFQCKHSMKYRLAFCRKTCGTC

SEQ ID NO: 142 - protein, 35 aa, Artificial Sequence
  ShK peptide sequence - ShK-A27
RSCIDTIPKSRCTAFQCKHSMKYRLSACRKTCGTC

SEQ ID NO: 143 - protein, 35 aa, Artificial Sequence
  ShK peptide sequence - ShK-X27
  MISC_FEATURE (27)..(27): Xaa is any nonfunctional amino acid residue.
RSCIDTIPKSRCTAFQCKHSMKYRLSXCRKTCGTC

SEQ ID NO: 144 - protein, 35 aa, Artificial Sequence
  ShK peptide sequence - ShK-A29
RSCIDTIPKSRCTAFQCKHSMKYRLSFCAKTCGTC

SEQ ID NO: 145 - protein, 35 aa, Artificial Sequence
  ShK peptide sequence - ShK-A30
RSCIDTIPKSRCTAFQCKHSMKYRLSFCRATCGTC

SEQ ID NO: 146 - protein, 35 aa, Artificial Sequence
  ShK peptide sequence - ShK-A31
RSCIDTIPKSRCTAFQCKHSMKYRLSFCRKACGTC

SEQ ID NO: 147 - protein, 35 aa, Artificial Sequence
  ShK peptide sequence - ShK-A34
RSCIDTIPKSRCTAFQCKHSMKYRLSFCRKTCGAC

SEQ ID NO: 148 - protein, 34 aa, Artificial Sequence
  ShK peptide sequence - ShK-A4d1
SCADTIPKSRCTAFQCKHSMKYRLSFCRKTCGTC

SEQ ID NO: 149 - protein, 34 aa, Artificial Sequence
  ShK peptide sequence - ShK-A4/A15d1
SCADTIPKSRCTAAQCKHSMKYRLSFCRKTCGTC

SEQ ID NO: 150 - protein, 34 aa, Artificial Sequence
  ShK peptide sequence - ShK-A4/A15/A25 d1
SCADTIPKSRCTAAQCKHSMKYRASFCRKTCGTC

SEQ ID NO: 151 - protein, 34 aa, Artificial Sequence
  ShK peptide sequence - ShK-A6 d1
SCIDAIPKSRCTAFQCKHSMKYRLSFCRKTCGTC

SEQ ID NO: 152 - protein, 34 aa, Artificial Sequence
  ShK peptide sequence - ShK-A7 d1
SCIDTAPKSRCTAFQCKHSMKYRLSFCRKTCGTC

SEQ ID NO: 153 - protein, 34 aa, Artificial Sequence
  ShK peptide sequence - ShK-A8 d1
SCIDTIAKSRCTAFQCKHSMKYRLSFCRKTCGTC

SEQ ID NO: 154 - protein, 34 aa, Artificial Sequence
  ShK peptide sequence - ShK-A9 d1
SCIDTIPASRCTAFQCKHSMKYRLSFCRKTCGTC

SEQ ID NO: 155 - protein, 34 aa, Artificial Sequence
  ShK peptide sequence - ShK-E9 d1
SCIDTIPESRCTAFQCKHSMKYRLSFCRKTCGTC

SEQ ID NO: 156 - protein, 34 aa, Artificial Sequence
  ShK peptide sequence - ShK-Q9 d1
SCIDTIPQSRCTAFQCKHSMKYRLSFCRKTCGTC

SEQ ID NO: 157 - protein, 34 aa, Artificial Sequence
  ShK peptide sequence - ShK-A10 d1
SCIDTIPKARCTAFQCKHSMKYRLSFCRKTCGTC

SEQ ID NO: 158 - protein, 34 aa, Artificial Sequence
  ShK peptide sequence - ShK-A11 d1
SCIDTIPKSACTAFQCKHSMKYRLSFCRKTCGTC

SEQ ID NO: 159 - protein, 34 aa, Artificial Sequence
  ShK peptide sequence - ShK-E11 d1
SCIDTIPKSECTAFQCKHSMKYRLSFCRKTCGTC

SEQ ID NO: 160 - protein, 34 aa, Artificial Sequence
  ShK peptide sequence - ShK-Q11 d1
SCIDTIPKSQCTAFQCKHSMKYRLSFCRKTCGTC

SEQ ID NO: 161 - protein, 34 aa, Artificial Sequence
  ShK peptide sequence - ShK-A13 d1
SCIDTIPKSRCAAFQCKHSMKYRLSFCRKTCGTC

SEQ ID NO: 162 - protein, 34 aa, Artificial Sequence
  ShK peptide sequence - ShK-A15 d1
SCIDTIPKSRCTAAQCKHSMKYRLSFCRKTCGTC

SEQ ID NO: 163 - protein, 34 aa, Artificial Sequence
  ShK peptide sequence - ShK-W15 d1
SCIDTIPKSRCTAWQCKHSMKYRLSFCRKTCGTC

SEQ ID NO: 164 - protein, 34 aa, Artificial Sequence
  ShK peptide sequence - ShK-X15 d1
  MISC_FEATURE (14)..(14): Xaa is any nonfunctional amino acid residue.
SCIDTIPKSRCTAXQCKHSMKYRLSFCRKTCGTC

SEQ ID NO: 165 - protein, 34 aa, Artificial Sequence
  ShK peptide sequence - ShK-A15/A25 d1
SCIDTIPKSRCTAAQCKHSMKYRASFCRKTCGTC

SEQ ID NO: 166 - protein, 34 aa, Artificial Sequence
  ShK peptide sequence - ShK-A16 d1
SCIDTIPKSRCTAFACKHSMKYRLSFCRKTCGTC

SEQ ID NO: 167 - protein, 34 aa, Artificial Sequence
  ShK peptide sequence - ShK-E16 d1
SCIDTIPKSRCTAFECKHSMKYRLSFCRKTCGTC

SEQ ID NO: 168 - protein, 34 aa, Artificial Sequence
  ShK peptide sequence - ShK-A18 d1
SCIDTIPKSRCTAFQCAHSMKYRLSFCRKTCGTC

SEQ ID NO: 169 - protein, 34 aa, Artificial Sequence
  ShK peptide sequence - ShK-E18 d1
SCIDTIPKSRCTAFQCEHSMKYRLSFCRKTCGTC

SEQ ID NO: 170 - protein, 34 aa, Artificial Sequence
  ShK peptide sequence - ShK-A19 d1
SCIDTIPKSRCTAFQCKASMKYRLSFCRKTCGTC

SEQ ID NO: 171 - protein, 34 aa, Artificial Sequence
  ShK peptide sequence - ShK-K19 d1
SCIDTIPKSRCTAFQCKKSMKYRLSFCRKTCGTC

SEQ ID NO: 172 - protein, 34 aa, Artificial Sequence
  ShK peptide sequence - ShK-A20 d1
SCIDTIPKSRCTAFQCKHAMKYRLSFCRKTCGTC

SEQ ID NO: 173 - protein, 34 aa, Artificial Sequence
  ShK peptide sequence - ShK-A21 d1
SCIDTIPKSRCTAFQCKHSAKYRLSFCRKTCGTC

SEQ ID NO: 174 - protein, 34 aa, Artificial Sequence
  ShK peptide sequence - ShK-X21 d1
  MISC_FEATURE (20)..(20): Xaa is any nonfunctional amino acid residue.
SCIDTIPKSRCTAFQCKHSXKYRLSFCRKTCGTC

SEQ ID NO: 175 - protein, 34 aa, Artificial Sequence; identical to SEQ ID NO: 174
  ShK peptide sequence - ShK-Nle21 d1
  MISC_FEATURE (20)..(20): Xaa is norleucine.

SEQ ID NO: 176 - protein, 34 aa, Artificial Sequence
  ShK peptide sequence - ShK-A22 d1
SCIDTIPKSRCTAFQCKHSMAYRLSFCRKTCGTC

SEQ ID NO: 177 - protein, 34 aa, Artificial Sequence
  ShK peptide sequence - ShK-E22 d1
SCIDTIPKSRCTAFQCKHSMEYRLSFCRKTCGTC

SEQ ID NO: 178 - protein, 34 aa, Artificial Sequence
  ShK peptide sequence - ShK-R22 d1
SCIDTIPKSRCTAFQCKHSMRYRLSFCRKTCGTC

SEQ ID NO: 179 - protein, 34 aa, Artificial Sequence
  ShK peptide sequence - ShK-X22 d1
  MISC_FEATURE (21)..(21): Xaa is any nonfunctional amino acid residue.
SCIDTIPKSRCTAFQCKHSMXYRLSFCRKTCGTC

SEQ ID NO: 180 - protein, 34 aa, Artificial Sequence; identical to SEQ ID NO: 179
  ShK peptide sequence - ShK-Nle22 d1
  MISC_FEATURE (21)..(21): Xaa is norleucine.

SEQ ID NO: 181 - protein, 34 aa, Artificial Sequence; identical to SEQ ID NO: 179
  ShK peptide sequence - ShK-Orn22 d1
  MISC_FEATURE (21)..(21): Xaa is ornithine.

SEQ ID NO: 182 - protein, 34 aa, Artificial Sequence; identical to SEQ ID NO: 179
  ShK peptide sequence - ShK-Homocit22 d1
  MISC_FEATURE (21)..(21): Xaa is homocitrulline.

SEQ ID NO: 183 - protein, 34 aa, Artificial Sequence; identical to SEQ ID NO: 179
  ShK peptide sequence - ShK-Diaminopropionic22 d1
  MISC_FEATURE (21)..(21): Xaa is diaminopropionic acid.

SEQ ID NO: 184 - protein, 34 aa, Artificial Sequence
  ShK peptide sequence - ShK-A23 d1
SCIDTIPKSRCTAFQCKHSMKARLSFCRKTCGTC

SEQ ID NO: 185 - protein, 34 aa, Artificial Sequence
  ShK peptide sequence - ShK-S23 d1
SCIDTIPKSRCTAFQCKHSMKSRLSFCRKTCGTC

SEQ ID NO: 186 - protein, 34 aa, Artificial Sequence
  ShK peptide sequence - ShK-F23 d1
SCIDTIPKSRCTAFQCKHSMKFRLSFCRKTCGTC

SEQ ID NO: 187 - protein, 34 aa, Artificial Sequence
  ShK peptide sequence - ShK-X23 d1
  MISC_FEATURE (22)..(22): Xaa is any nonfunctional amino acid residue.
SCIDTIPKSRCTAFQCKHSMKXRLSFCRKTCGTC

SEQ ID NO: 188 - protein, 34 aa, Artificial Sequence; identical to SEQ ID NO: 187
  ShK peptide sequence - - ShK-Nitrophe23 d1
  MISC_FEATURE (22)..(22): Xaa is nitrophenaylalanine.

SEQ ID NO: 189 - protein, 34 aa, Artificial Sequence; identical to SEQ ID NO: 187
  ShK peptide sequence - ShK-Aminopheala23 d1
  MISC_FEATURE (22)..(22): Xaa is aminophenylalanine.

SEQ ID NO: 190 - protein, 34 aa, Artificial Sequence; identical to SEQ ID NO: 187
  ShK peptide sequence - ShK-Benzoylpheala23 d1
  MISC_FEATURE (22)..(22): Xaa is benzoylphenylalanine.

SEQ ID NO: 191 - protein, 34 aa, Artificial Sequence
  ShK peptide sequence - ShK-A24 d1
SCIDTIPKSRCTAFQCKHSMKYALSFCRKTCGTC

SEQ ID NO: 192 - protein, 34 aa, Artificial Sequence
  ShK peptide sequence - ShK-E24 d1
SCIDTIPKSRCTAFQCKHSMKYELSFCRKTCGTC

SEQ ID NO: 193 - protein, 34 aa, Artificial Sequence
  ShK peptide sequence - - ShK-A25 d1
SCIDTIPKSRCTAFQCKHSMKYRASFCRKTCGTC

SEQ ID NO: 194 - protein, 34 aa, Artificial Sequence
  ShK peptide sequence - ShK-A26 d1
SCIDTIPKSRCTAFQCKHSMKYRLAFCRKTCGTC

SEQ ID NO: 195 - protein, 34 aa, Artificial Sequence
  ShK peptide sequence - ShK-A27 d1
SCIDTIPKSRCTAFQCKHSMKYRLSACRKTCGTC

SEQ ID NO: 196 - protein, 34 aa, Artificial Sequence
  ShK peptide sequence - ShK-X27 d1
  MISC_FEATURE (26)..(26): Xaa is any nonfunctional amino acid residue.
SCIDTIPKSRCTAFQCKHSMKYRLSXCRKTCGTC

SEQ ID NO: 197 - protein, 34 aa, Artificial Sequence
  ShK peptide sequence - ShK-A29 d1
SCIDTIPKSRCTAFQCKHSMKYRLSFCAKTCGTC

SEQ ID NO: 198 - protein, 34 aa, Artificial Sequence
  ShK peptide sequence - ShK-A30 d1
SCIDTIPKSRCTAFQCKHSMKYRLSFCRATCGTC

SEQ ID NO: 199 - protein, 34 aa, Artificial Sequence
  ShK peptide sequence - ShK-A31 d1
SCIDTIPKSRCTAFQCKHSMKYRLSFCRKACGTC

SEQ ID NO: 200 - protein, 34 aa, Artificial Sequence
  ShK peptide sequence - ShK-A34 d1
SCIDTIPKSRCTAFQCKHSMKYRLSFCRKTCGAC

SEQ ID NO: 201 - protein, 35 aa, Artificial Sequence
  HmK peptide sequence - HmK-A1
ATCKDLIPVSECTDIRCRTSMKYRLNLCRKTCGSC

SEQ ID NO: 202 - protein, 35 aa, Artificial Sequence
  HmK peptide sequence - HmK-S1
STCKDLIPVSECTDIRCRTSMKYRLNLCRKTCGSC

SEQ ID NO: 203 - protein, 34 aa, Artificial Sequence
  HmK peptide sequence - HmK-d1
TCKDLIPVSECTDIRCRTSMKYRLNLCRKTCGSC

SEQ ID NO: 204 - protein, 34 aa, Artificial Sequence
  HmK peptide sequence -  HmK-d1/S2
SCKDLIPVSECTDIRCRTSMKYRLNLCRKTCGSC

SEQ ID NO: 205 - protein, 34 aa, Artificial Sequence
  HmK peptide sequence - HmK-d1/l4
TCIDLIPVSECTDIRCRTSMKYRLNLCRKTCGSC

SEQ ID NO: 206 - protein, 34 aa, Artificial Sequence
  HmK peptide sequence - HmK-d1T6
TCKDTIPVSECTDIRCRTSMKYRLNLCRKTCGSC

SEQ ID NO: 207 - protein, 34 aa, Artificial Sequence
  HmK peptide sequence - HmK-d1/K9
TCKDLIPKSECTDIRCRTSMKYRLNLCRKTCGSC

SEQ ID NO: 208 - protein, 34 aa, Artificial Sequence
  HmK peptide sequence - HmK-d1/R11
TCKDLIPVSRCTDIRCRTSMKYRLNLCRKTCGSC

SEQ ID NO: 209 - protein, 34 aa, Artificial Sequence
  HmK peptide sequence - HmK-d1/A14
TCKDLIPVSECTAIRCRTSMKYRLNLCRKTCGSC

SEQ ID NO: 210 - protein, 34 aa, Artificial Sequence
  HmK peptide sequence - HmK-d1/F15
TCKDLIPVSECTDFRCRTSMKYRLNLCRKTCGSC

SEQ ID NO: 211 - protein, 34 aa, Artificial Sequence
  HmK peptide sequence - HmK-d1/Q16
TCKDLIPVSECTDIQCRTSMKYRLNLCRKTCGSC

SEQ ID NO: 212 - protein, 34 aa, Artificial Sequence
  HmK peptide sequence - HmK-d1/K18
TCKDLIPVSECTDIRCKTSMKYRLNLCRKTCGSC

SEQ ID NO: 213 - protein, 34 aa, Artificial Sequence
  HmK peptide sequence - HmK-d1/H19
TCKDLIPVSECTDIRCRHSMKYRLNLCRKTCGSC

SEQ ID NO: 214 - protein, 34 aa, Artificial Sequence
  HmK peptide sequence - HmK-d1/S26
TCKDLIPVSECTDIRCRTSMKYRLSLCRKTCGSC

SEQ ID NO: 215 - protein, 34 aa, Artificial Sequence
  HmK peptide sequence - HmK-d1/F27
TCKDLIPVSECTDIRCRTSMKYRLNFCRKTCGSC

SEQ ID NO: 216 - protein, 34 aa, Artificial Sequence
  HmK peptide sequence - HmK-d1/T34
TCKDLIPVSECTDIRCRTSMKYRLNLCRKTCGTC

SEQ ID NO: 217 - protein, 34 aa, Artificial Sequence
  HmK peptide sequence - HmK-d1/R11/F27
TCKDLIPVSRCTDIRCRTSMKYRLNFCRKTCGSC

SEQ ID NO: 218 - protein, 35 aa, Artificial Sequence
  HmK peptide sequence - HmK-A1/R11/F27
ATCKDLIPVSRCTDIRCRTSMKYRLNFCRKTCGSC

SEQ ID NO: 219 - protein, 34 aa, Artificial Sequence
  HmK peptide sequence - HmK-d1/Z1
TCIDTIPKSRCTAFQCKHSMKYRLSFCRKTCGSC

SEQ ID NO: 220 - protein, 34 aa, Artificial Sequence
  HmK peptide sequence - HmK-d1/Z2
TCIDTIPKSRCTAFQCRTSMKYRLNFCRKTCGSC

SEQ ID NO: 221 - protein, 34 aa, Artificial Sequence
  HmK peptide sequence - HmK-d1Z3
TCADLIPASRCTAIACRTSMKYRLNFCRKTCGSC

SEQ ID NO: 222 - protein, 34 aa, Artificial Sequence
  HmK peptide sequence - HmK-d1/Z4
TCADLIPASRCTAIACKHSMKYRLNFCRKTCGSC

SEQ ID NO: 223 - protein, 34 aa, Artificial Sequence
  HmK peptide sequence - HmK-d1/Z5
TCADLIPASRCTAIACAHSMKYRLNFCRKTCGSC

SEQ ID NO: 224 - protein, 35 aa, Artificial Sequence
  HmK peptide sequence - HmK-X22
  MISC_FEATURE (22)..(22): Xaa is a nonfunctional amino acid residue.
RTCKDLIPVSECTDIRCRTSMXYRLNLCRKTCGSC

SEQ ID NO: 225 - protein, 35 aa, Artificial Sequence
  HmK peptide sequence - HmK-X6,22,26
  MISC_FEATURE (7)..(7): Xaa  in positions 7, 23, and 27 are each independently nonfunctional amino acid residues.
  MISC_FEATURE (23)..(23): Xaa  in positions 7, 23, and 27 are each independently nonfunctional amino acid residues.
  MISC_FEATURE (27)..(27): Xaa  in positions 7, 23, and 27 are each independently nonfunctional amino acid residues.
ATCKDLXPVSRCTDIRCRTSMKXRLNXCRKTCGSC

SEQ ID NO: 226 - protein, 37 aa, Artificial Sequence
  BgK peptide sequence - BhK-A1
ACRDWFKETACRHAKSLGNCRTSQKYRANCAKTCELC

SEQ ID NO: 227 - protein, 37 aa, Artificial Sequence
  BgK peptide sequence - BgK-A3
VCADWFKETACRHAKSLGNCRTSQKYRANCAKTCELC

SEQ ID NO: 228 - protein, 37 aa, Artificial Sequence
  BgK peptide sequence - BgK-A5
VCRDAFKETACRHAKSLGNCRTSQKYRANCAKTCELC

SEQ ID NO: 229 - protein, 37 aa, Artificial Sequence
  BgK peptide sequence - BgK-A8
VCRDWFKATACRHAKSLGNCRTSQKYRANCAKTCELC

SEQ ID NO: 230 - protein, 37 aa, Artificial Sequence
  BgK peptide sequence - BgK-A9
VCRDWFKEAACRHAKSLGNCRTSQKYRANCAKTCELC

SEQ ID NO: 231 - protein, 37 aa, Artificial Sequence
  BgK peptide sequence - BgK-A12
VCRDWFKETACAHAKSLGNCRTSQKYRANCAKTCELC

SEQ ID NO: 232 - protein, 37 aa, Artificial Sequence
  BgK peptide sequence - BgK-A15
VCRDWFKETACRHAASLGNCRTSQKYRANCAKTCELC

SEQ ID NO: 233 - protein, 37 aa, Artificial Sequence
  BgK peptide sequence - BgK-A16
VCRDWFKETACRHAKALGNCRTSQKYRANCAKTCELC

SEQ ID NO: 234 - protein, 37 aa, Artificial Sequence
  BgK peptide sequence - BgK-A17
VCRDWFKETACRHAKSAGNCRTSQKYRANCAKTCELC

SEQ ID NO: 235 - protein, 37 aa, Artificial Sequence
  BgK peptide sequence - BgK-A21
VCRDWFKETACRHAKSLGNCATSQKYRANCAKTCELC

SEQ ID NO: 236 - protein, 37 aa, Artificial Sequence
  BgK peptide sequence - BgK-A22
VCRDWFKETACRHAKSLGNCRASQKYRANCAKTCELC

SEQ ID NO: 237 - protein, 37 aa, Artificial Sequence
  BgK peptide sequence - BgK-A27
VCRDWFKETACRHAKSLGNCRTSQKYAANCAKTCELC

SEQ ID NO: 238 - protein, 37 aa, Artificial Sequence
  BgK peptide sequence - BgK-A32
VCRDWFKETACRHAKSLGNCRTSQKYRANCAATCELC

SEQ ID NO: 239 - protein, 37 aa, Artificial Sequence
  BgK peptide sequence - BgK-A33
VCRDWFKETACRHAKSLGNCRTSQKYRANCAKACELC

SEQ ID NO: 240 - protein, 37 aa, Artificial Sequence
  BgK peptide sequence - BgK-A35
VCRDWFKETACRHAKSLGNCRTSQKYRANCAKTCALC

SEQ ID NO: 241 - protein, 37 aa, Artificial Sequence
  BgK peptide sequence - BgK-A37
VCRDWFKETACRHAKSLGNCRTSQKYRANCAKTCEAC

SEQ ID NO: 242 - protein, 39 aa, Artificial Sequence
  MgTx peptide sequence -  MgTx-A6
TIINVACTSPKQCLPPCKAQFGQSAGAKCMNGKCKCYPH

SEQ ID NO: 243 - protein, 39 aa, Artificial Sequence
  MgTx peptide sequence - MgTx-S6
TIINVSCTSPKQCLPPCKAQFGQSAGAKCMNGKCKCYPH

SEQ ID NO: 244 - protein, 39 aa, Artificial Sequence
  MgTx peptide sequence -  MgTx-A11
TIINVKCTSPAQCLPPCKAQFGQSAGAKCMNGKCKCYPH

SEQ ID NO: 245 - protein, 39 aa, Artificial Sequence
  MgTx peptide sequence - MgTx-A18
TIINVKCTSPKQCLPPCAAQFGQSAGAKCMNGKCKCYPH

SEQ ID NO: 246 - protein, 39 aa, Artificial Sequence
  MgTx peptide sequence - MgTx-A28
TIINVKCTSPKQCLPPCKAQFGQSAGAACMNGKCKCYPH

SEQ ID NO: 247 - protein, 39 aa, Artificial Sequence
  MgTx peptide sequence - MgTx-A33
TIINVKCTSPKQCLPPCKAQFGQSAGAKCMNGACKCYPH

SEQ ID NO: 248 - protein, 39 aa, Artificial Sequence
  MgTx peptide sequence -  MgTx-A35
TIINVKCTSPKQCLPPCKAQFGQSAGAKCMNGKCACYPH

SEQ ID NO: 249 - protein, 39 aa, Artificial Sequence
  MgTx peptide sequence - MgTx-H39N
TIINVKCTSPKQCLPPCKAQFGQSAGAKCMNGKCKCYPN

SEQ ID NO: 250 - protein, 39 aa, Artificial Sequence
  MgTx peptide sequence - MgTx-A6/H39N
TIINVACTSPKQCLPPCKAQFGQSAGAKCMNGKCKCYPN

SEQ ID NO: 251 - protein, 38 aa, Artificial Sequence
  MgTx peptide sequence - MgTxS6/38/d39
TIINVSCTSPKQCLPPCKAQFGQSAGAKCMNGKCKCYS

SEQ ID NO: 252 - protein, 39 aa, Artificial Sequence
  MgTx peptide sequence - MgTx-T4/15/S6
TIITISCTSPKQCLPPCKAQFGQSAGAKCMNGKCKCYPH

SEQ ID NO: 253 - protein, 36 aa, Artificial Sequence
  MgTx peptide sequence - MgTx-d3/T4/15/S6
TISCTSPKQCLPPCKAQFGQSAGAKCMNGKCKCYPH

SEQ ID NO: 254 - protein, 36 aa, Artificial Sequence
  MgTx peptide sequence - MgTx-Pi2
TISCTSPKQCLPPCKAQFGQSAGAKCMNGKCKCFGR

SEQ ID NO: 255 - protein, 36 aa, Artificial Sequence
  MgTx peptide sequence - MgTx-d3/A6
NVACTSPKQCLPPCKAQFGQSAGAKCMNGKCKCYPH

SEQ ID NO: 256 - protein, 38 aa, Artificial Sequence
  MgTx peptide sequence - MgTx-ChTx
QFTNVSCTSPKQCLPPCKAQFGQSAGAKCMNGKCKCYS

SEQ ID NO: 257 - protein, 38 aa, Artificial Sequence
  MgTx peptide sequence - MgTx-lbTx
QFTDVDCTSPKQCLPPCKAQFGQSAGAKCMNGKCKCYQ

SEQ ID NO: 258 - protein, 38 aa, Artificial Sequence
  MgTx peptide sequence - MgTx-Z1
IINVSCTSPKQCLPPCKAQFGQSAGAKCMNGKCKCYPH

SEQ ID NO: 259 - protein, 38 aa, Artificial Sequence
  MgTx peptide sequence - MgTx-Z2
IITISCTSPKQCLPPCKAQFGQSAGAKCMNGKCKCYPH

SEQ ID NO: 260 - protein, 40 aa, Artificial Sequence
  MgTx peptide sequence - MgTx-Z3
GVIINVSCTSPKQCLPPCKAQFGQSAGAKCMNGKCKCYPH

SEQ ID NO: 261 - protein, 38 aa, Artificial Sequence
  AgTx2 peptide sequence -  AgTx2-A5
GVPIAVSCTGSPQCIKPCKDAGMRFGKCMNRKCHCTPK

SEQ ID NO: 262 - protein, 38 aa, Artificial Sequence
  AgTx2 peptide sequence -  AgTx2-A16
GVPINVSCTGSPQCIAPCKDAGMRFGKCMNRKCHCTPK

SEQ ID NO: 263 - protein, 38 aa, Artificial Sequence
  AgTx2 peptide sequence - AgTx2-A19
GVPINVSCTGSPQCIKPCADAGMRFGKCMNRKCHCTPK

SEQ ID NO: 264 - protein, 38 aa, Artificial Sequence
  AgTx2 peptide sequence -  AgTx2-A24
GVPINVSCTGSPQCIKPCKDAGMAFGKCMNRKCHCTPK

SEQ ID NO: 265 - protein, 38 aa, Artificial Sequence
  AgTx2 peptide sequence - AgTx2-A27
GVPINVSCTGSPQCIKPCKDAGMRFGACMNRKCHCTPK

SEQ ID NO: 266 - protein, 38 aa, Artificial Sequence
  AgTx2 peptide sequence - AgTx2-A31
GVPINVSCTGSPQCIKPCKDAGMRFGKCMNAKCHCTPK

SEQ ID NO: 267 - protein, 38 aa, Artificial Sequence
  AgTx2 peptide sequence - AgTx2-A32
GVPINVSCTGSPQCIKPCKDAGMRFGKCMNRACHCTPK

SEQ ID NO: 268 - protein, 38 aa, Artificial Sequence
  AgTx2 peptide sequence - AgTx2-A38
GVPINVSCTGSPQCIKPCKDAGMRFGKCMNRKCHCTPA

SEQ ID NO: 269 - protein, 38 aa, Artificial Sequence
  AgTx2 peptide sequence - AgTx2-A5/A38
GVPIAVSCTGSPQCIKPCKDAGMRFGKCMNRKCHCTPA

SEQ ID NO: 270 - protein, 38 aa, Artificial Sequence
  AgTx2 peptide sequence -  AgTx2-G31
GVPINVSCTGSPQCIKPCKDAGMRFGKCMNGKCHCTPK

SEQ ID NO: 271 - protein, 38 aa, Artificial Sequence
  AgTx2 peptide sequence - AgTx2-OSK_z1
GVPIIVSCKGSRQCIKPCKDAGMRFGKCMNGKCHCTPK

SEQ ID NO: 272 - protein, 38 aa, Artificial Sequence
  AgTx2 peptide sequence - AgTx2-OSK_z2
GVPIIVSCKISRQCIKPCKDAGMRFGKCMNGKCHCTPK

SEQ ID NO: 273 - protein, 38 aa, Artificial Sequence
  AgTx2 peptide sequence - AgTx2-OSK_z3
GVPIIVKCKGSRQCIKPCKDAGMRFGKCMNGKCHCTPK

SEQ ID NO: 274 - protein, 38 aa, Artificial Sequence
  AgTx2 peptide sequence - AgTx2-OSK_z4
GVPIIVKCKISRQCIKPCKDAGMRFGKCMNGKCHCTPK

SEQ ID NO: 275 - protein, 38 aa, Artificial Sequence; identical to SEQ ID NO: 274
  AgTx2 peptide sequence - AgTx2-OSK_z5

SEQ ID NO: 276 - protein, 34 aa, Artificial Sequence
  Heteromitrus spinnifer peptide sequence - HsTx1-X4
  MISC_FEATURE (4)..(4): Xaa is any amino acid residue.
ASCXTPKDCADPCRKETGCPYGKCMNRKCKCNRC

SEQ ID NO: 277 - protein, 34 aa, Artificial Sequence
  Heteromitrus spinnifer peptide sequence - HsTx1-A4
ASCATPKDCADPCRKETGCPYGKCMNRKCKCNRC

SEQ ID NO: 278 - protein, 34 aa, Artificial Sequence
  Heteromitrus spinnifer peptide sequence -  HsTx1-X7
  MISC_FEATURE (7)..(7): Xaa is any amino acid residue.
ASCRTPXDCADPCRKETGCPYGKCMNRKCKCNRC

SEQ ID NO: 279 - protein, 34 aa, Artificial Sequence
  Heteromitrus spinnifer peptide sequence - HsTx1-A7
ASCRTPADCADPCRKETGCPYGKCMNRKCKCNRC

SEQ ID NO: 280 - protein, 34 aa, Artificial Sequence
  Heteromitrus spinnifer peptide sequence - HsTx1-X14
  MISC_FEATURE (14)..(14): Xaa is any amino acid residue.
ASCRTPKDCADPCXKETGCPYGKCMNRKCKCNRC

SEQ ID NO: 281 - protein, 34 aa, Artificial Sequence
  Heteromitrus spinnifer peptide sequence - HsTx1-A14
ASCRTPKDCADPCAKETGCPYGKCMNRKCKCNRC

SEQ ID NO: 282 - protein, 34 aa, Artificial Sequence
  Heteromitrus spinnifer peptide sequence - HsTx1-X15
  MISC_FEATURE (15)..(15): Xaa is any amino acid residue.
ASCRTPKDCADPCRXETGCPYGKCMNRKCKCNRC

SEQ ID NO: 283 - protein, 34 aa, Artificial Sequence
  Heteromitrus spinnifer peptide sequence - HsTx1-A15
ASCRTPKDCADPCRAETGCPYGKCMNRKCKCNRC

SEQ ID NO: 284 - protein, 34 aa, Artificial Sequence
  Heteromitrus spinnifer peptide sequence - HsTx1-X23
  MISC_FEATURE (23)..(23): Xaa is any amino acid residue.
ASCRTPKDCADPCRKETGCPYGXCMNRKCKCNRC

SEQ ID NO: 285 - protein, 34 aa, Artificial Sequence
  Heteromitrus spinnifer peptide sequence - HsTx1-A23
ASCRTPKDCADPCRKETGCPYGACMNRKCKCNRC

SEQ ID NO: 286 - protein, 34 aa, Artificial Sequence
  Heteromitrus spinnifer peptide sequence - HsTx1-X27
  MISC_FEATURE (27)..(27): Xaa is any amino acid residue.
ASCRTPKDCADPCRKETGCPYGKCMNXKCKCNRC

SEQ ID NO: 287 - protein, 34 aa, Artificial Sequence
  Heteromitrus spinnifer peptide sequence - HsTx1-A27
ASCRTPKDCADPCRKETGCPYGKCMNAKCKCNRC

SEQ ID NO: 288 - protein, 34 aa, Artificial Sequence
  Heteromitrus spinnifer peptide sequence - HsTx1-X28
  MISC_FEATURE (28)..(28): Xaa is any amino acid residue.
ASCRTPKDCADPCRKETGCPYGKCMNRXCKCNRC

SEQ ID NO: 289 - protein, 34 aa, Artificial Sequence
  Heteromitrus spinnifer peptide sequence - HsTx1-A28
ASCRTPKDCADPCRKETGCPYGKCMNRACKCNRC

SEQ ID NO: 290 - protein, 34 aa, Artificial Sequence
  Heteromitrus spinnifer peptide sequence - HsTx1-X30
  MISC_FEATURE (30)..(30): Xaa can be any amino acid residue.
ASCRTPKDCADPCRKETGCPYGKCMNRKCXCNRC

SEQ ID NO: 291 - protein, 34 aa, Artificial Sequence
  Heteromitrus spinnifer peptide sequence - HxTx1-A30
ASCRTPKDCADPCRKETGCPYGKCMNRKCACNRC

SEQ ID NO: 292 - protein, 34 aa, Artificial Sequence
  Heteromitrus spinnifer peptide sequence - HsTx1-X33
  MISC_FEATURE (33)..(33): Xaa can be any amino acid residue.
ASCRTPKDCADPCRKETGCPYGKCMNRKCKCNXC

SEQ ID NO: 293 - protein, 34 aa, Artificial Sequence
  Heteromitrus spinnifer peptide sequence - HsTx1-A33
ASCRTPKDCADPCRKETGCPYGKCMNRKCKCNAC

SEQ ID NO: 294 - protein, 38 aa, Artificial Sequence
  OSK1 peptide sequence - OSK1-K16
GVIINVKCKISRQCLKPCKKAGMRFGKCMNGKCHCTPK

SEQ ID NO: 295 - protein, 38 aa, Artificial Sequence
  OSK1 peptide sequence - OSK1-D20
GVIINVKCKISRQCLEPCKDAGMRFGKCMNGKCHCTPK

SEQ ID NO: 296 - protein, 38 aa, Artificial Sequence
  OSK1 peptide sequence - OSK1-K16,D20
GVIINVKCKISRQCLKPCKDAGMRFGKCMNGKCHCTPK

SEQ ID NO: 297 - protein, 38 aa, Artificial Sequence
  OSK1 peptide sequence - PSL1-P12,K16,D20
GVIINVKCKISPQCLKPCKDAGMRFGKCMNGKCHCTPK

SEQ ID NO: 298 - protein, 38 aa, Artificial Sequence
  OSK1-K16,D20,Y36
GVIINVKCKISRQCLKPCKDAGMRFGKCMNGKCHCYPK

SEQ ID NO: 299 - protein, 35 aa, Artificial Sequence
  Pi2 peptide sequence - Pi2-X8
  MISC_FEATURE (8)..(8): Xaa can be any amino acid residue.
TISCTNPXQCYPHCKKETGYPNAKCMNRKCKCFGR

SEQ ID NO: 300 - protein, 35 aa, Artificial Sequence
  Pi2 peptide sequence -  Pi2-A8
TISCTNPAQCYPHCKKETGYPNAKCMNRKCKCFGR

SEQ ID NO: 301 - protein, 35 aa, Artificial Sequence
  Pi2 peptide sequence - Pi2-X15
  MISC_FEATURE (15)..(15): Xaa can be any amino acid residue.
TISCTNPKQCYPHCXKETGYPNAKCMNRKCKCFGR

SEQ ID NO: 302 - protein, 35 aa, Artificial Sequence
  Pi2 peptide sequence -  Pi2-A15
TISCTNPKQCYPHCAKETGYPNAKCMNRKCKCFGR

SEQ ID NO: 303 - protein, 35 aa, Artificial Sequence
  Pi2 peptide sequence -  Pi2-X16
  MISC_FEATURE (16)..(16): Xaa can be any amino acid residue.
TISCTNPKQCYPHCKXETGYPNAKCMNRKCKCFGR

SEQ ID NO: 304 - protein, 35 aa, Artificial Sequence
  Pi2 peptide sequence -  Pi2-A16
TISCTNPKQCYPHCKAETGYPNAKCMNRKCKCFGR

SEQ ID NO: 305 - protein, 35 aa, Artificial Sequence
  Pi2 peptide sequence -  Pi2-X24
  MISC_FEATURE (24)..(24): Xaa can be any amino acid residue.
TISCTNPKQCYPHCKKETGYPNAXCMNRKCKCFGR

SEQ ID NO: 306 - protein, 35 aa, Artificial Sequence
  Pi2 peptide sequence -  Pi2-A24
TISCTNPKQCYPHCKKETGYPNAACMNRKCKCFGR

SEQ ID NO: 307 - protein, 35 aa, Artificial Sequence
  Pi2 peptide sequence -  Pi2-X28
  MISC_FEATURE (28)..(28): Xaa can be any amino acid residue.
TISCTNPKQCYPHCKKETGYPNAKCMNXKCKCFGR

SEQ ID NO: 308 - protein, 35 aa, Artificial Sequence
  Pi2 peptide sequence -  Pi2-A28
TISCTNPKQCYPHCKKETGYPNAKCMNAKCKCFGR

SEQ ID NO: 309 - protein, 35 aa, Artificial Sequence
  Pi2 peptide sequence -  Pi2-X29
  MISC_FEATURE (29)..(29): Xaa can be any amino acid residue.
TISCTNPKQCYPHCKKETGYPNAKCMNRXCKCFGR

SEQ ID NO: 310 - protein, 35 aa, Artificial Sequence
  Pi2 peptide sequence -  Pi2-A29
TISCTNPKQCYPHCKKETGYPNAKCMNRACKCFGR

SEQ ID NO: 311 - protein, 35 aa, Artificial Sequence
  Pi2 peptide sequence -  Pi2-X31
  MISC_FEATURE (31)..(31): Xaa can be any amino acid residue.
TISCTNPKQCYPHCKKETGYPNAKCMNRKCXCFGR

SEQ ID NO: 312 - protein, 35 aa, Artificial Sequence
  Pi2 peptide sequence -  Pi2-A31
TISCTNPKQCYPHCKKETGYPNAKCMNRKCACFGR

SEQ ID NO: 313 - protein, 35 aa, Artificial Sequence
  Pi2 peptide sequence -  Pi2-X35
  MISC_FEATURE (35)..(35): Xaa can be any amino acid residue.
TISCTNPKQCYPHCKKETGYPNAKCMNRKCKCFGX

SEQ ID NO: 314 - protein, 35 aa, Artificial Sequence
  Pi2 peptide sequence -  Pi2-A35
TISCTNPKQCYPHCKKETGYPNAKCMNRKCKCFGA

SEQ ID NO: 315 - protein, 34 aa, Artificial Sequence
  Pi2 peptide sequence -  Pi2-d35
TISCTNPKQCYPHCKKETGYPNAKCMNRKCKCFG

SEQ ID NO: 316 - protein, 34 aa, Artificial Sequence
  Anuroctoxin peptide sequence - AnTx-d1
KECTGPQHCTNFCRKNKCTHGKCMNRKCKCFNCK

SEQ ID NO: 317 - protein, 34 aa, Artificial Sequence
  Anuroctoxin peptide sequence - AnTx-d1, X2
  MISC_FEATURE (1)..(1): Xaa can be any amino acid residue.
XECTGPQHCTNFCRKNKCTHGKCMNRKCKCFNCK

SEQ ID NO: 318 - protein, 34 aa, Artificial Sequence
  Anuroctoxin peptide sequence - AnTxd1,A2
AECTGPQHCTNFCRKNKCTHGKCMNRKCKCFNCK

SEQ ID NO: 319 - protein, 39 aa, Artificial Sequence
  Noxiustoxin (NTX) peptide sequence - NTX-A6
TIINVACTSPKQCSKPCKELYGSSAGAKCMNGKCKCYNN

SEQ ID NO: 320 - protein, 39 aa, Artificial Sequence
  Noxiustoxin (NTX) peptide sequence - NTX-R25
TIINVKCTSPKQCSKPCKELYGSSRGAKCMNGKCKCYNN

SEQ ID NO: 321 - protein, 39 aa, Artificial Sequence
  Noxiustoxin (NTX) peptide sequence - NTX-S10
TIINVKCTSSKQCSKPCKELYGSSAGAKCMNGKCKCYNN

SEQ ID NO: 322 - protein, 39 aa, Artificial Sequence
  Noxiustoxin (NTX) peptide sequence - NTX-W14
TIINVKCTSPKQCWKPCKELYGSSAGAKCMNGKCKCYNN

SEQ ID NO: 323 - protein, 38 aa, Artificial Sequence
  Noxiustoxin (NTX) peptide sequence - NTX-A25d
TIINVKCTSPKQCSKPCKELYGSSGAKCMNGKCKCYNN

SEQ ID NO: 324 - protein, 38 aa, Artificial Sequence
  Noxiustoxin (NTX) peptide sequence - NTX-lbTx1
TIINVKCTSPKQCSKPCKELFGVDRGKCMNGKCKCYNN

SEQ ID NO: 325 - protein, 37 aa, Artificial Sequence
  Noxiustoxin (NTX) peptide sequence - NTX-lBTX2
TIINVKCTSPKQCWKPCKELFGVDRGKCMNGKCKCYN

SEQ ID NO: 326 - protein, 37 aa, Artificial Sequence
  Kaliotoxin 1 (KTX1) peptide sequence - KTX2
VRIPVSCKHSGQCLKPCKDAGMRFGKCMNGKCDCTPK

SEQ ID NO: 327 - protein, 38 aa, Artificial Sequence
  Kaliotoxin 1 (KTX1) peptide sequence - KTX1-S7
GVEINVSCSGSPQCLKPCKDAGMRFGKCMNRKCHCTPK

SEQ ID NO: 328 - protein, 38 aa, Artificial Sequence
  Kaliotoxin 1 (KTX1) peptide sequence - KTX1-A7
GVEINVACSGSPQCLKPCKDAGMRFGKCMNRKCHCTPK

SEQ ID NO: 329 - protein, 37 aa, Artificial Sequence
  IKCa1 peptide inhibitor sequence - ChTx-Lq2
QFTQESCTASNQCWSICKRLHNTNRGKCMNKKCRCYS

SEQ ID NO: 330 - protein, 34 aa, Artificial Sequence
  Maurotoxin (MTx) peptide sequence - MTX-A4
VSCAGSKDCYAPCRKQTGCPNAKCINKSCKCYGC

SEQ ID NO: 331 - protein, 34 aa, Artificial Sequence
  Maurotoxin (MTx) peptide sequence - MTX-A6
VSCTGAKDCYAPCRKQTGCPNAKCINKSCKCYGC

SEQ ID NO: 332 - protein, 34 aa, Artificial Sequence
  Maurotoxin (MTx) peptide sequence -  MTX-A7
VSCTGSADCYAPCRKQTGCPNAKCINKSCKCYGC

SEQ ID NO: 333 - protein, 34 aa, Artificial Sequence
  Maurotoxin (MTx) peptide sequence - MTX-A10
VSCTGSKDCAAPCRKQTGCPNAKCINKSCKCYGC

SEQ ID NO: 334 - protein, 34 aa, Artificial Sequence
  Maurotoxin (MTx) peptide sequence - MTX-Q14
VSCTGSKDCYAPCQKQTGCPNAKCINKSCKCYGC

SEQ ID NO: 335 - protein, 34 aa, Artificial Sequence
  Maurotoxin (MTx) peptide sequence - MTX-Q15
VSCTGSKDCYAPCRQQTGCPNAKCINKSCKCYGC

SEQ ID NO: 336 - protein, 34 aa, Artificial Sequence
  Maurotoxin (MTx) peptide sequence - MTX-Q14,15
VSCTGSKDCYAPCQQQTGCPNAKCINKSCKCYGC

SEQ ID NO: 337 - protein, 34 aa, Artificial Sequence
  Maurotoxin (MTx) peptide sequence - MTX-A33
VSCTGSKDCYAPCRKQTGCPNAKCINKSCKCYAC

SEQ ID NO: 338 - protein, 34 aa, Artificial Sequence
  Maurotoxin (MTx) peptide sequence - MTX-HsTx1
VSCTGSKDCYAPCRKQTGCPYGKCMNRKCKCNRC

SEQ ID NO: 339 - protein, 34 aa, Artificial Sequence
  Maurotoxin (MTx) peptide sequence - MTX-A12,20
VSCTGSKDCYAACRKQTGCANAKCINKSCKCYGC

SEQ ID NO: 340 - protein, 34 aa, Artificial Sequence
  Maurotoxin (MTx) peptide sequence - MTX-X19,34
  MISC_FEATURE (19)..(19): Xaa in positions 19 and 34 are each independently nonfuctional residues.
  MISC_FEATURE (34)..(34): Xaa in positions 19 and 34 are each independently nonfuctional residues.
VSCTGSKDCYAPCRKQTGXPNAKCINKSCKCYGX

SEQ ID NO: 341 - protein, 34 aa, Artificial Sequence
  Maurotoxin (MTx) peptide sequence - MTX-S19,34
VSCTGSKDCYAPCRKQTGSPNAKCINKSCKCYGS

SEQ ID NO: 342 - protein, 34 aa, Artificial Sequence; identical to SEQ ID NO: 332
  Maurotoxin (MTx) peptide sequence - MTX-A7

SEQ ID NO: 343 - protein, 38 aa, Artificial Sequence
  Maurotoxin (MTx) peptide sequence - Tsk-MTX
VVIGQRCTGSKDCYAPCRKQTGCPNAKCINKSCKCYGC

SEQ ID NO: 344 - protein, 37 aa, Artificial Sequence
  Charybdotoxin (ChTx)peptide sequence - ChTx-D32
QFTNVSCTTSKECWSVCQRLHNTSRGKCMNKDCRCYS

SEQ ID NO: 345 - protein, 31 aa, Artificial Sequence
  Charybdotoxin (ChTx)peptide sequence - ChTx_d1-d6
CTTSKECWSVCQRLHNTSRGKCMNKKCRCYS

SEQ ID NO: 346 - protein, 37 aa, Artificial Sequence
  Charybdotoxin (ChTx)peptide sequence - ChTx-lbTx
QFTNVSCTTSKECWSVCQRLFGVDRGKCMGKKCRCYQ

SEQ ID NO: 347 - protein, 26 aa, Artificial Sequence
  N type Ca channel peptide inhibitor sequence - SVIB
CKLKGQSCRKTSYDCCSGSCGRSGKC

SEQ ID NO: 348 - protein, 19 aa, Artificial Sequence
  Apamin peptide inhibitor sequence - Ap-X4
  MISC_FEATURE (4)..(4): Xaa can be any amino acid residue.
CNCXAPETALCARRCQQHG

SEQ ID NO: 349 - protein, 19 aa, Artificial Sequence
  Apamin peptide inhibitor sequence - Ap-A4
CNCAAPETALCARRCQQHG

SEQ ID NO: 350 - protein, 19 aa, Artificial Sequence
  Apamin peptide inhibitor sequence - Ap-X13
  MISC_FEATURE (13)..(13): Xaa can be any amino acid residue.
CNCKAPETALCAXRCQQHG

SEQ ID NO: 351 - protein, 19 aa, Artificial Sequence
  Apamin peptide inhibitor sequence - Ap-A13
CNCKAPETALCAARCQQHG

SEQ ID NO: 352 - protein, 19 aa, Artificial Sequence
  Apamin peptide inhibitor sequence - Ap-X14
  MISC_FEATURE (14)..(14): Xaa can be any amino acid residue.
CNCKAPETALCARXCQQHG

SEQ ID NO: 353 - protein, 19 aa, Artificial Sequence
  Apamin peptide inhibitor sequence - Ap-A14
CNCKAPETALCARACQQHG

SEQ ID NO: 354 - protein, 31 aa, Artificial Sequence
  Scyllatoxin (ScyTx), BMP05, PO5, Tamapin, P01 peptide inhibitor sequence - ScyTx-R7
AFCNLRRCQLSCRSLGLLGKCIGDKCECVKH

SEQ ID NO: 355 - protein, 31 aa, Artificial Sequence
  Scyllatoxin (ScyTx), BMP05, PO5, Tamapin, P01 peptide inhibitor sequence - ScyTx-lbTx
AFCNLRMCQLSCRSLGLLGKCMGKKCRCVKH

SEQ ID NO: 356 - protein, 31 aa, Artificial Sequence
  Scyllatoxin (ScyTx), BMP05, PO5, Tamapin, P01 peptide inhibitor sequence - ScyTx-C/S
AFSNLRMCQLSCRSLGLLGKSIGDKCECVKH

SEQ ID NO: 357 - protein, 37 aa, Artificial Sequence
  IbTx (Slotoxin family) peptide inhibitor sequence - IbTx-X11
  MISC_FEATURE (11)..(11): Xaa can be any amino acid residue.
QFTDVDCSVSXECWSVCKDLFGVDRGKCMGKKCRCYQ

SEQ ID NO: 358 - protein, 37 aa, Artificial Sequence
  IbTx (Slotoxin family) peptide inhibitor sequence - IbTx-A11
QFTDVDCSVSAECWSVCKDLFGVDRGKCMGKKCRCYQ

SEQ ID NO: 359 - protein, 37 aa, Artificial Sequence
  IbTx (Slotoxin family) peptide inhibitor sequence - IbTx-X18
  MISC_FEATURE (18)..(18): Xaa can be any amino acid residue.
QFTDVDCSVSKECWSVCXDLFGVDRGKCMGKKCRCYQ

SEQ ID NO: 360 - protein, 37 aa, Artificial Sequence
  IbTx (Slotoxin family) peptide inhibitor sequence - IbTx-A18
QFTDVDCSVSKECWSVCADLFGVDRGKCMGKKCRCYQ

SEQ ID NO: 361 - protein, 37 aa, Artificial Sequence
  IbTx (Slotoxin family) peptide inhibitor sequence - IbTx-X25
  MISC_FEATURE (25)..(25): Xaa can be any amino acid residue.
QFTDVDCSVSKECWSVCKDLFGVDXGKCMGKKCRCYQ

SEQ ID NO: 362 - protein, 37 aa, Artificial Sequence
  IbTx (Slotoxin family) peptide inhibitor sequence - IbTx-A25
QFTDVDCSVSKECWSVCKDLFGVDAGKCMGKKCRCYQ

SEQ ID NO: 363 - protein, 37 aa, Artificial Sequence
  IbTx (Slotoxin family) peptide inhibitor sequence - IbTx-X27
  MISC_FEATURE (27)..(27): Xaa can be any amino acid residue.
QFTDVDCSVSKECWSVCKDLFGVDRGXCMGKKCRCYQ

SEQ ID NO: 364 - protein, 37 aa, Artificial Sequence
  IbTx,  (Slotoxin family) peptide inhibitor sequence - IbTx-A27
QFTDVDCSVSKECWSVCKDLFGVDRGACMGKKCRCYQ

SEQ ID NO: 365 - protein, 37 aa, Artificial Sequence
  IbTx (Slotoxin family) peptide inhibitor sequence - IbTx-X31
  MISC_FEATURE (31)..(31): Xaa can be any amino acid residue.
QFTDVDCSVSKECWSVCKDLFGVDRGKCMGXKCRCYQ

SEQ ID NO: 366 - protein, 37 aa, Artificial Sequence
  IbTx (Slotoxin family) peptide inhibitor sequence - IbTx-A31
QFTDVDCSVSKECWSVCKDLFGVDRGKCMGAKCRCYQ

SEQ ID NO: 367 - protein, 37 aa, Artificial Sequence
  IbTx (Slotoxin family) peptide inhibitor sequence - IbTx-X32
  MISC_FEATURE (32)..(32): Xaa can be any amino acid residue.
QFTDVDCSVSKECWSVCKDLFGVDRGKCMGKXCRCYQ

SEQ ID NO: 368 - protein, 37 aa, Artificial Sequence
  IbTx (Slotoxin family) peptide inhibitor sequence - IbTx-A32
QFTDVDCSVSKECWSVCKDLFGVDRGKCMGKACRCYQ

SEQ ID NO: 369 - protein, 37 aa, Artificial Sequence
  IbTx peptide inhibitor sequence - IbTx-X34
  MISC_FEATURE (34)..(34): Xaa can be any amino acid residue.
QFTDVDCSVSKECWSVCKDLFGVDRGKCMGKKCXCYQ

SEQ ID NO: 370 - protein, 37 aa, Artificial Sequence
  IbTx (Slotoxin family) peptide inhibitor sequence - IbTx-A34
QFTDVDCSVSKECWSVCKDLFGVDRGKCMGKKCACYQ

SEQ ID NO: 371 - protein, 37 aa, Artificial Sequence; identical to SEQ ID NO: 40
  Slotoxin peptide inhibitor sequence - SloTx

SEQ ID NO: 372 - protein, 37 aa, Artificial Sequence
  Slotoxin peptide inhibitor sequence - SloTx-X6
  MISC_FEATURE (6)..(6): Xaa can be any amino acid residue.
QFTDVXCTGSKQCWPVCKQMFGKPNGKCMNGKCRCYS

SEQ ID NO: 373 - protein, 37 aa, Artificial Sequence
  Slotoxin peptide inhibitor sequence - SloTx-A6
QFTDVACTGSKQCWPVCKQMFGKPNGKCMNGKCRCYS

SEQ ID NO: 374 - protein, 37 aa, Artificial Sequence
  Slotoxin peptide inhibitor sequence - SloTx-X11
  MISC_FEATURE (11)..(11): Xaa can be any amino acid residue.
QFTDVKCTGSXQCWPVCKQMFGKPNGKCMNGKCRCYS

SEQ ID NO: 375 - protein, 37 aa, Artificial Sequence
  Slotoxin peptide inhibitor sequence - SloTx-A11
QFTDVKCTGSAQCWPVCKQMFGKPNGKCMNGKCRCYS

SEQ ID NO: 376 - protein, 37 aa, Artificial Sequence
  Slotoxin peptide inhibitor sequence - SloTx-X18
  MISC_FEATURE (18)..(18): Xaa can be any amino acid residue.
QFTDVKCTGSKQCWPVCXQMFGKPNGKCMNGKCRCYS

SEQ ID NO: 377 - protein, 37 aa, Artificial Sequence
  Slotoxin peptide inhibitor sequence - SloTx-A18
QFTDVKCTGSKQCWPVCAQMFGKPNGKCMNGKCRCYS

SEQ ID NO: 378 - protein, 37 aa, Artificial Sequence
  Slotoxin peptide inhibitor sequence - SloTx-X23
  MISC_FEATURE (23)..(23): Xaa can be any amino acid residue.
QFTDVKCTGSKQCWPVCKQMFGXPNGKCMNGKCRCYS

SEQ ID NO: 379 - protein, 37 aa, Artificial Sequence
  Slotoxin peptide inhibitor sequence - SloTx-A23
QFTDVKCTGSKQCWPVCKQMFGAPNGKCMNGKCRCYS

SEQ ID NO: 380 - protein, 37 aa, Artificial Sequence
  Slotoxin peptide inhibitor sequence - SloTx-X27
  MISC_FEATURE (27)..(27): Xaa can be any amino acid residue.
QFTDVKCTGSKQCWPVCKQMFGKPNGXCMNGKCRCYS

SEQ ID NO: 381 - protein, 37 aa, Artificial Sequence
  Slotoxin peptide inhibitor sequence - SloTx-A27
QFTDVKCTGSKQCWPVCKQMFGKPNGACMNGKCRCYS

SEQ ID NO: 382 - protein, 37 aa, Artificial Sequence
  Slotoxin peptide inhibitor sequence - SloTx-X32
  MISC_FEATURE (32)..(32): Xaa can be any amino acid residue.
QFTDVKCTGSKQCWPVCKQMFGKPNGKCMNGXCRCYS

SEQ ID NO: 383 - protein, 36 aa, Artificial Sequence
  Slotoxin peptide inhibitor sequence - SloTx-A32
QFTDVKCTGSKQCWPVCKQMFGKPNGKCMNGARCYS

SEQ ID NO: 384 - protein, 36 aa, Artificial Sequence
  Slotoxin peptide inhibitor sequence - SloTx-X34
  MISC_FEATURE (34)..(34): Xaa can be any amino acid residue.
QFTDVKCTGSKQCWPVCKQMFGKPNGKCMNGKCXYS

SEQ ID NO: 385 - protein, 36 aa, Artificial Sequence
  Slotoxin peptide inhibitor sequence - SloTx-A34
QFTDVKCTGSKQCWPVCKQMFGKPNGKCMNGKCAYS

SEQ ID NO: 386 - protein, 41 aa, Artificial Sequence; identical to SEQ ID NO: 41
  BuTX (Slotoxin family) peptide inhibitor sequence - BuTx

SEQ ID NO: 387 - protein, 40 aa, Artificial Sequence
  BuTX (Slotoxin family) peptide inhibitor sequence - BuTx-X14
  MISC_FEATURE (14)..(14): Xaa can be any amino acid residue.
WCSTCLDLACGASXCYDPCFKAFGRAHGKCMNNKCRCYTN

SEQ ID NO: 388 - protein, 40 aa, Artificial Sequence
  BuTX (Slotoxin family) peptide inhibitor sequence - BuTx-A14
WCSTCLDLACGASACYDPCFKAFGRAHGKCMNNKCRCYTN

SEQ ID NO: 389 - protein, 40 aa, Artificial Sequence
  BuTX (Slotoxin family) peptide inhibitor sequence - BiTx-X22
  MISC_FEATURE (22)..(22): Xaa can be any amino acid residue.
WCSTCLDLACGASRECYDPCFXFGRAHGKCMNNKCRCYTN

SEQ ID NO: 390 - protein, 39 aa, Artificial Sequence
  BuTX (Slotoxin family) peptide inhibitor sequence - BuTx-A22
WCSTCLDLACGASRECYDPCFAGRAHGKCMNNKCRCYTN

SEQ ID NO: 391 - protein, 40 aa, Artificial Sequence
  BuTX (Slotoxin family) peptide inhibitor sequence - BuTx-X26
  MISC_FEATURE (26)..(26): Xaa can be any amino acid residue.
WCSTCLDLACGASRECYDPCFKAFGXHGKCMNNKCRCYTN

SEQ ID NO: 392 - protein, 40 aa, Artificial Sequence
  BuTX (Slotoxin family) peptide inhibitor sequence - BuTx-A26
WCSTCLDLACGASRECYDPCFKAFGAHGKCMNNKCRCYTN

SEQ ID NO: 393 - protein, 40 aa, Artificial Sequence
  BuTX (Slotoxin family) peptide inhibitor sequence - BuTx-X30
  MISC_FEATURE (30)..(30): Xaa can be any amino acid residue.
WCSTCLDLACGASRECYDPCFKAFGRAHGXMNNKCRCYTN

SEQ ID NO: 394 - protein, 40 aa, Artificial Sequence
  BuTX (Slotoxin family) peptide inhibitor sequence - BuTx-A30
WCSTCLDLACGASRECYDPCFKAFGRAHGAMNNKCRCYTN

SEQ ID NO: 395 - protein, 40 aa, Artificial Sequence
  BuTX (Slotoxin family) peptide inhibitor sequence - BuTx-X35
  MISC_FEATURE (35)..(35): Xaa can be any amino acid residue.
WCSTCLDLACGASRECYDPCFKAFGRAHGKCMNNXRCYTN

SEQ ID NO: 396 - protein, 40 aa, Artificial Sequence
  BuTX (Slotoxin family) peptide inhibitor sequence - BuTx-A35
WCSTCLDLACGASRECYDPCFKAFGRAHGKCMNNARCYTN

SEQ ID NO: 397 - protein, 40 aa, Artificial Sequence
  BuTX (Slotoxin family) peptide inhibitor sequence - BuTx-X37
  MISC_FEATURE (37)..(37): Xaa can be any amino acid residue.
WCSTCLDLACGASRECYDPCFKAFGRAHGKCMNNKCXYTN

SEQ ID NO: 398 - protein, 40 aa, Artificial Sequence
  BuTX (Slotoxin family) peptide inhibitor sequence - BuTx-A37
WCSTCLDLACGASRECYDPCFKAFGRAHGKCMNNKCAYTN

SEQ ID NO: 399 - protein, 37 aa, Artificial Sequence
  Martentoxin peptide inhibitor sequence - Marten Tx-X7
  MISC_FEATURE (7)..(7): Xaa can be any amino acid residue.
FGLIDVXCFASSECWTACKKVTGSGQGKCQNNQCRCY

SEQ ID NO: 400 - protein, 37 aa, Artificial Sequence
  Martentoxin peptide inhibitor sequence - Marten Tx-A7
FGLIDVACFASSECWTACKKVTGSGQGKCQNNQCRCY

SEQ ID NO: 401 - protein, 37 aa, Artificial Sequence
  Martentoxin peptide inhibitor sequence - Marten Tx-X19
  MISC_FEATURE (19)..(19): Xaa can be any amino acid residue.
FGLIDVKCFASSECWTACXKVTGSGQGKCQNNQCRCY

SEQ ID NO: 402 - protein, 37 aa, Artificial Sequence
  Martentoxin peptide inhibitor sequence - MartenTx-A19
FGLIDVKCFASSECWTACAKVTGSGQGKCQNNQCRCY

SEQ ID NO: 403 - protein, 37 aa, Artificial Sequence
  Martentoxin peptide inhibitor sequence - MartenTx-X20
  MISC_FEATURE (20)..(20): Xaa can be any amino acid residue.
FGLIDVKCFASSECWTACKXVTGSGQGKCQNNQCRCY

SEQ ID NO: 404 - protein, 37 aa, Artificial Sequence
  Martentoxin peptide inhibitor sequence - Marten Tx-A20
FGLIDVKCFASSECWTACKAVTGSGQGKCQNNQCRCY

SEQ ID NO: 405 - protein, 37 aa, Artificial Sequence
  Martentoxin peptide inhibitor sequence - MartenTx-X28
  MISC_FEATURE (28)..(28): Xaa can be any amino acid residue.
FGLIDVKCFASSECWTACKKVTGSGQGXCQNNQCRCY

SEQ ID NO: 406 - protein, 37 aa, Artificial Sequence
  Martentoxin peptide inhibitor sequence - MartenTx-A28
FGLIDVKCFASSECWTACKKVTGSGQGACQNNQCRCY

SEQ ID NO: 407 - protein, 37 aa, Artificial Sequence
  Martentoxin peptide inhibitor sequence - MartenTx-X35
  MISC_FEATURE (35)..(35): Xaa can be any amino acid residue.
FGLIDVKCFASSECWTACKKVTGSGQGKCQNNQCXCY

SEQ ID NO: 408 - protein, 37 aa, Artificial Sequence
  Martentoxin peptide inhibitor sequence - MartenTx-A35
FGLIDVKCFASSECWTACKKVTGSGQGKCQNNQCACY

SEQ ID NO: 409 - protein, 27 aa, Artificial Sequence
  N type Ca channel peptide inhibitor sequence - CVIA
CKSKGAKCSKLMYDCCTGSCSGTVGRC

SEQ ID NO: 410 - protein, 25 aa, Artificial Sequence
  wMVIIA peptide inhibitor sequence - MVIIA-X2
  MISC_FEATURE (2)..(2): Xaa can be any amino acid residue.
CXGKGAKCSRLMYDCCTGSCRSGKC

SEQ ID NO: 411 - protein, 25 aa, Artificial Sequence
  wMVIIA peptide inhibitor sequence - MVIIA-A2
CAGKGAKCSRLMYDCCTGSCRSGKC

SEQ ID NO: 412 - protein, 25 aa, Artificial Sequence
  wMVIIA peptide inhibitor sequence - MVIIA-X4
  MISC_FEATURE (4)..(4): Xaa can be any amino acid residue.
CKGXGAKCSRLMYDCCTGSCRSGKC

SEQ ID NO: 413 - protein, 25 aa, Artificial Sequence
  wMVIIA peptide inhibitor sequence - MVIIA-A4
CKGAGAKCSRLMYDCCTGSCRSGKC

SEQ ID NO: 414 - protein, 25 aa, Artificial Sequence
  wMVIIA peptide inhibitor sequence - MVIIA-X7
  MISC_FEATURE (7)..(7): Xaa can be any amino acid residue.
CKGKGAXCSRLMYDCCTGSCRSGKC

SEQ ID NO: 415 - protein, 25 aa, Artificial Sequence
  wMVIIA peptide inhibitor sequence - MVIIA-A7
CKGKGAACSRLMYDCCTGSCRSGKC

SEQ ID NO: 416 - protein, 25 aa, Artificial Sequence
  wMVIIA peptide inhibitor sequence - MVIIA-X10
  MISC_FEATURE (10)..(10): Xaa can be any amino acid residue.
CKGKGAKCSXLMYDCCTGSCRSGKC

SEQ ID NO: 417 - protein, 25 aa, Artificial Sequence
  wMVIIA peptide inhibitor sequence - MVIIA-A10
CKGKGAKCSALMYDCCTGSCRSGKC

SEQ ID NO: 418 - protein, 25 aa, Artificial Sequence
  wMVIIA peptide inhibitor sequence - MVIIA-X21
  MISC_FEATURE (21)..(21): Xaa can be any amino acid residue.
CKGKGAKCSRLMYDCCTGSCXSGKC

SEQ ID NO: 419 - protein, 25 aa, Artificial Sequence
  wMVIIA peptide inhibitor sequence - MVIIA-A21
CKGKGAKCSRLMYDCCTGSCASGKC

SEQ ID NO: 420 - protein, 25 aa, Artificial Sequence
  wMVIIA peptide inhibitor sequence - MVIIA-X24
  MISC_FEATURE (24)..(24): Xaa can be any amino acid residue.
CKGKGAKCSRLMYDCCTGSCRSGXC

SEQ ID NO: 421 - protein, 25 aa, Artificial Sequence
  wMVIIA peptide inhibitor sequence - MVIIA-A24
CKGKGAKCSRLMYDCCTGSCRSGAC

SEQ ID NO: 422 - protein, 27 aa, Artificial Sequence
  wGVIA peptide inhibitor sequence - GVIA-X2
  MISC_FEATURE (2)..(2): Xaa can be any amino acid residue.
CXSPGSSCSPTSYNCCRSCNPYTKRCY

SEQ ID NO: 423 - protein, 27 aa, Artificial Sequence
  wGVIA peptide inhibitor sequence - GVIA-A2
CASPGSSCSPTSYNCCRSCNPYTKRCY

SEQ ID NO: 424 - protein, 27 aa, Artificial Sequence
  wGVIA peptide inhibitor sequence - GVIA-X17
  MISC_FEATURE (17)..(17): Xaa can be any amino acid residue.
CKSPGSSCSPTSYNCCXSCNPYTKRCY

SEQ ID NO: 425 - protein, 27 aa, Artificial Sequence
  wGVIA peptide inhibitor sequence - GVIA-A17
CKSPGSSCSPTSYNCCASCNPYTKRCY

SEQ ID NO: 426 - protein, 27 aa, Artificial Sequence
  wGVIA peptide inhibitor sequence - GVIA-X24
  MISC_FEATURE (24)..(24): Xaa can be any amino acid residue.
CKSPGSSCSPTSYNCCRSCNPYTXRCY

SEQ ID NO: 427 - protein, 27 aa, Artificial Sequence
  wGVIA peptide inhibitor sequence - GVIA-A24
CKSPGSSCSPTSYNCCRSCNPYTARCY

SEQ ID NO: 428 - protein, 27 aa, Artificial Sequence
  wGVIA peptide inhibitor sequence - GVIA-X25
  MISC_FEATURE (25)..(25): Xaa can be any amino acid residue.
CKSPGSSCSPTSYNCCRSCNPYTKXCY

SEQ ID NO: 429 - protein, 27 aa, Artificial Sequence
  wGVIA peptide inhibitor sequence - GVIA-A25
CKSPGSSCSPTSYNCCRSCNPYTKACY

SEQ ID NO: 430 - protein, 34 aa, Artificial Sequence
  Ptu1 peptide inhibitor sequence - Ptu1-X3
  MISC_FEATURE (3)..(3): Xaa can be any amino acid residue.
AEXDCIAPGAPCFGTDKPCCNPRAWCSSYANKCL

SEQ ID NO: 431 - protein, 34 aa, Artificial Sequence
  Ptu1 peptide inhibitor sequence - Ptu1-A3
AEADCIAPGAPCFGTDKPCCNPRAWCSSYANKCL

SEQ ID NO: 432 - protein, 34 aa, Artificial Sequence
  Ptu1 peptide inhibitor sequence - Ptu1-X17
  MISC_FEATURE (17)..(17): Xaa can be any amino acid residue.
AEKDCIAPGAPCFGTDXPCCNPRAWCSSYANKCL

SEQ ID NO: 433 - protein, 34 aa, Artificial Sequence
  Ptu1 peptide inhibitor sequence - Ptu1-A17
AEKDCIAPGAPCFGTDAPCCNPRAWCSSYANKCL

SEQ ID NO: 434 - protein, 34 aa, Artificial Sequence
  Ptu1 peptide inhibitor sequence - Ptu1-X23
  MISC_FEATURE (23)..(23): Xaa can be any amino acid residue.
AEKDCIAPGAPCFGTDKPCCNPXAWCSSYANKCL

SEQ ID NO: 435 - protein, 34 aa, Artificial Sequence
  Ptu1 peptide inhibitor sequence - Ptu1-A23
AEKDCIAPGAPCFGTDKPCCNPAAWCSSYANKCL

SEQ ID NO: 436 - protein, 34 aa, Artificial Sequence
  Ptu1 peptide inhibitor sequence - Ptu1-X32
  MISC_FEATURE (32)..(32): Xaa can be any amino acid residue.
AEKDCIAPGAPCFGTDKPCCNPRAWCSSYANXCL

SEQ ID NO: 437 - protein, 34 aa, Artificial Sequence
  Ptu1 peptide inhibitor sequence - Ptu1-A32
AEKDCIAPGAPCFGTDKPCCNPRAWCSSYANACL

SEQ ID NO: 438 - protein, 35 aa, Artificial Sequence
  T type Ca channel peptide inhibitor sequence - ProTx1-X3
  MISC_FEATURE (3)..(3): Xaa can be any amino acid residue.
ECXYWLGGCSAGQTCCKHLVCSRRHGWCVWDGTFS

SEQ ID NO: 439 - protein, 35 aa, Artificial Sequence
  T type Ca channel peptide inhibitor sequence - ProTx1-A3
ECAYWLGGCSAGQTCCKHLVCSRRHGWCVWDGTFS

SEQ ID NO: 440 - protein, 35 aa, Artificial Sequence
  T type Ca channel peptide inhibitor sequence - ProTx1-X17
  MISC_FEATURE (17)..(17): Xaa can be any amino acid residue.
ECRYWLGGCSAGQTCCXHLVCSRRHGWCVWDGTFS

SEQ ID NO: 441 - protein, 35 aa, Artificial Sequence
  T type Ca channel peptide inhibitor sequence - ProTx1-A17
ECRYWLGGCSAGQTCCAHLVCSRRHGWCVWDGTFS

SEQ ID NO: 442 - protein, 35 aa, Artificial Sequence
  T type Ca channel peptide inhibitor sequence - ProTx1-X23
  MISC_FEATURE (23)..(23): Xaa can be any amino acid residue.
ECRYWLGGCSAGQTCCKHLVCSXRHGWCVWDGTFS

SEQ ID NO: 443 - protein, 35 aa, Artificial Sequence
  T type Ca channel peptide inhibitor sequence - ProTx1-A23
ECRYWLGGCSAGQTCCKHLVCSARHGWCVWDGTFS

SEQ ID NO: 444 - protein, 35 aa, Artificial Sequence
  T type Ca channel peptide inhibitor sequence - ProTx1-X24
  MISC_FEATURE (24)..(24): Xaa can be any amino acid residue.
ECRYWLGGCSAGQTCCKHLVCSRXHGWCVWDGTFS

SEQ ID NO: 445 - protein, 35 aa, Artificial Sequence
  T type Ca channel peptide inhibitor sequence - ProTx1-A24
ECRYWLGGCSAGQTCCKHLVCSRAHGWCVWDGTFS

SEQ ID NO: 446 - protein, 35 aa, Artificial Sequence
  M current peptide inhibitor sequence - BeKM1-d1
PTDIKCSESYQCFPVCKSRFGKTNGRCVNGFCDCF

SEQ ID NO: 447 - protein, 36 aa, Artificial Sequence
  M current peptide inhibitor sequence - BeKM1-X1
  MISC_FEATURE (1)..(1): Xaa can be any amino acid residue.
XPTDIKCSESYQCFPVCKSRFGKTNGRCVNGFCDCF

SEQ ID NO: 448 - protein, 36 aa, Artificial Sequence
  M current peptide inhibitor sequence - BeKM1-A1
APTDIKCSESYQCFPVCKSRFGKTNGRCVNGFCDCF

SEQ ID NO: 449 - protein, 36 aa, Artificial Sequence
  M current peptide inhibitor sequence - BeKM1-X6
  MISC_FEATURE (6)..(6): Xaa can be any amino acid residue.
RPTDIXCSESYQCFPVCKSRFGKTNGRCVNGFCDCF

SEQ ID NO: 450 - protein, 36 aa, Artificial Sequence
  M current peptide inhibitor sequence - BeKM1-A6
RPTDIACSESYQCFPVCKSRFGKTNGRCVNGFCDCF

SEQ ID NO: 451 - protein, 36 aa, Artificial Sequence
  M current peptide inhibitor sequence - BeKM1-X18
  MISC_FEATURE (18)..(18): Xaa can be any amino acid residue.
RPTDIKCSESYQCFPVCXSRFGKTNGRCVNGFCDCF

SEQ ID NO: 452 - protein, 36 aa, Artificial Sequence
  M current peptide inhibitor sequence - BeKM1-A18
RPTDIKCSESYQCFPVCASRFGKTNGRCVNGFCDCF

SEQ ID NO: 453 - protein, 36 aa, Artificial Sequence
  M current peptide inhibitor sequence - BeKM1-X20
  MISC_FEATURE (20)..(20): Xaa can be any amino acid residue.
RPTDIKCSESYQCFPVCKSXFGKTNGRCVNGFCDCF

SEQ ID NO: 454 - protein, 36 aa, Artificial Sequence
  M current peptide inhibitor sequence - BeKM1-A20
RPTDIKCSESYQCFPVCKSAFGKTNGRCVNGFCDCF

SEQ ID NO: 455 - protein, 36 aa, Artificial Sequence
  M current peptide inhibitor sequence - BeKm1-X23
  MISC_FEATURE (23)..(23): Xaa can be any amino acid residue.
RPTDIKCSESYQCFPVCKSRFGXTNGRCVNGFCDCF

SEQ ID NO: 456 - protein, 36 aa, Artificial Sequence
  M current peptide inhibitor sequence - BeKM1-A23
RPTDIKCSESYQCFPVCKSRFGATNGRCVNGFCDCF

SEQ ID NO: 457 - protein, 36 aa, Artificial Sequence
  M current peptide inhibitor sequence - BeKM1-X27
  MISC_FEATURE (27)..(27): Xaa can be any amino acid residue.
RPTDIKCSESYQCFPVCKSRFGKTNGXCVNGFCDCF

SEQ ID NO: 458 - protein, 36 aa, Artificial Sequence
  M current peptide inhibitor sequence - BeKM1-A27
RPTDIKCSESYQCFPVCKSRFGKTNGACVNGFCDCF

SEQ ID NO: 459 - protein, 22 aa, Artificial Sequence
  Na channel peptide inhibitor sequence - Smllla
QRCCNGRRGCSSRWCRDHSRCC

SEQ ID NO: 460 - protein, 22 aa, Artificial Sequence
  Na channel peptide inhibitor sequence - mu-GIIIA
  MISC_FEATURE (6)..(6): Xaa is hydroxyproline in positions 6, 7, and 17.
  MISC_FEATURE (7)..(7): Xaa is hydroxyproline in positions 6, 7, and 17.
  MISC_FEATURE (17)..(17): Xaa is hydroxyproline in positions 6, 7, and 17.
RDCCTXXKKCKDRQCKXQRCCA

SEQ ID NO: 461 - protein, 22 aa, Artificial Sequence
  Na channel peptide inhibitor sequence - mu-GIIIB
  MISC_FEATURE (6)..(6): Xaa is hydroxyproline in positions 6, 7, and 17.
  MISC_FEATURE (7)..(7): Xaa is hydroxyproline in positions 6, 7, and 17.
  MISC_FEATURE (17)..(17): Xaa is hydroxyproline in positions 6, 7, and 17.
RDCCTXXRKCKDRRCKXMRCCA

SEQ ID NO: 462 - protein, 22 aa, Artificial Sequence
  Na channel peptide inhibitor sequence - mu-PIIIA
  MISC_FEATURE (8)..(8): Xaa is hydroxyproline in positions 8 and 18.
  MISC_FEATURE (18)..(18): Xaa is hydroxyproline in positions 8 and 18.
ZRLCCGFXKSCRSRQCKXHRCC

SEQ ID NO: 463 - protein, 22 aa, Artificial Sequence
  Na channel peptide inhibitor sequence - mu-SmIIIA
ZRCCNGRRGCSSRWCRDHSRCC

SEQ ID NO: 464 - protein, 31 aa, Artificial Sequence
  Na channel peptide inhibitor sequence - muO-MrVIA
ACRKKWEYCIVPIIGFIYCCPGLICGPFVCV

SEQ ID NO: 465 - protein, 31 aa, Artificial Sequence
  Na channel peptide inhibitor sequence - muO-MrVIB
ACSKKWEYCIVPIIGFIYCCPGLICGPFVCV

SEQ ID NO: 466 - protein, 29 aa, Artificial Sequence
  Na channel peptide inhibitor sequence - delta-PVIA
  MISC_FEATURE (6)..(6): Xaa is hydroxyproline in positions 6 and 14.
  MISC_FEATURE (14)..(14): Xaa is hydroxyproline in positions 6 and 14.
EACYAXGTFCGIKXGLCCSEFCLPGVCFG

SEQ ID NO: 467 - protein, 31 aa, Artificial Sequence
  Na channel peptide inhibitor sequence - delta-SVIE
  MISC_FEATURE (14)..(14): Xaa is hydroxyproline.
DGCSSGGTFCGIHXGLCCSEFCFLWCITFID

SEQ ID NO: 468 - protein, 27 aa, Artificial Sequence
  Na channel peptide inhibitor sequence - delta-TxVIA
WCKQSGEMCNLLDQNCCDGYCIVLVCT

SEQ ID NO: 469 - protein, 29 aa, Artificial Sequence
  Na channel peptide inhibitor sequence - delta-GmVIA
VKPCRKEGQLCDPIFQNCCRGWNCVLFCV

SEQ ID NO: 470 - protein, 36 aa, Artificial Sequence
  CI channel peptide inhibitor sequence - CTX-X14
  MISC_FEATURE (14)..(14): Xaa can be any amino acid residue.
MCMPCFTTDHQMAXKCDDCCGGKGRGKCYGPQCLCR

SEQ ID NO: 471 - protein, 36 aa, Artificial Sequence
  CI channel peptide inhibitor sequence - CTX-A14
MCMPCFTTDHQMAAKCDDCCGGKGRGKCYGPQCLCR

SEQ ID NO: 472 - protein, 36 aa, Artificial Sequence
  CI channel peptide inhibitor sequence - CTX-X15
  MISC_FEATURE (15)..(15): Xaa can be any amino acid residue.
MCMPCFTTDHQMARXCDDCCGGKGRGKCYGPQCLCR

SEQ ID NO: 473 - protein, 36 aa, Artificial Sequence
  CI channel peptide inhibitor sequence - CTX-A15
MCMPCFTTDHQMARACDDCCGGKGRGKCYGPQCLCR

SEQ ID NO: 474 - protein, 36 aa, Artificial Sequence
  CI channel peptide inhibitor sequence - CTX-X23
  MISC_FEATURE (23)..(23): Xaa can be any amino acid residue.
MCMPCFTTDHQMARKCDDCCGGXGRGKCYGPQCLCR

SEQ ID NO: 475 - protein, 36 aa, Artificial Sequence
  CI channel peptide inhibitor sequence - CTX-A23
MCMPCFTTDHQMARKCDDCCGGAGRGKCYGPQCLCR

SEQ ID NO: 476 - protein, 36 aa, Artificial Sequence
  CI channel peptide inhibitor sequence - CTX-X25
  MISC_FEATURE (25)..(25): Xaa can be any amino acid residue.
MCMPCFTTDHQMARKCDDCCGGKGXGKCYGPQCLCR

SEQ ID NO: 477 - protein, 36 aa, Artificial Sequence
  CI channel peptide inhibitor sequence - CTX-A25
MCMPCFTTDHQMARKCDDCCGGKGAGKCYGPQCLCR

SEQ ID NO: 478 - protein, 36 aa, Artificial Sequence
  CI channel peptide inhibitor sequence - CTX-X27
  MISC_FEATURE (27)..(27): Xaa can be any amino acid residue.
MCMPCFTTDHQMARKCDDCCGGKGRGXCYGPQCLCR

SEQ ID NO: 479 - protein, 36 aa, Artificial Sequence
  CI channel peptide inhibitor sequence - CTX-A27
MCMPCFTTDHQMARKCDDCCGGKGRGACYGPQCLCR

SEQ ID NO: 480 - protein, 36 aa, Artificial Sequence
  CI channel peptide inhibitor sequence - CTX-X36
  MISC_FEATURE (36)..(36): Xaa in position 36 is any amino acid.
MCMPCFTTDHQMARKCDDCCGGKGRGKCYGPQCLCX

SEQ ID NO: 481 - protein, 36 aa, Artificial Sequence
  CI channel peptide inhibitor sequence - CTX-A36
MCMPCFTTDHQMARKCDDCCGGKGRGKCYGPQCLCA

SEQ ID NO: 482 - protein, 35 aa, Artificial Sequence
  CI channel peptide inhibitor sequence - CTX-d36
MCMPCFTTDHQMARKCDDCCGGKGRGKCYGPQCLC

SEQ ID NO: 483 - protein, 39 aa, Artificial Sequence
  CI channel peptide inhibitor sequence - Bm-12b
QTDGCGPCFTTDANMARKCRECCGGNGKCFGPQCLCNRE

SEQ ID NO: 484 - protein, 39 aa, Artificial Sequence
  CI channel peptide inhibitor sequence - Bm-12b-X17
  MISC_FEATURE (17)..(17): Xaa can be any amino acid residue.
QTDGCGPCFTTDANMAXKCRECCGGNGKCFGPQCLCNRE

SEQ ID NO: 485 - protein, 39 aa, Artificial Sequence
  CI channel peptide inhibitor sequence - Bm-12b-A17
QTDGCGPCFTTDANMAAKCRECCGGNGKCFGPQCLCNRE

SEQ ID NO: 486 - protein, 39 aa, Artificial Sequence
  CI channel peptide inhibitor sequence - Bm-12b-X18
  MISC_FEATURE (18)..(18): Xaa can be any amino acid residue.
QTDGCGPCFTTDANMARXCRECCGGNGKCFGPQCLCNRE

SEQ ID NO: 487 - protein, 39 aa, Artificial Sequence
  CI channel peptide inhibitor sequence - Bm-12b-A18
QTDGCGPCFTTDANMARACRECCGGNGKCFGPQCLCNRE

SEQ ID NO: 488 - protein, 39 aa, Artificial Sequence
  CI channel peptide inhibitor sequence - Bm-12b-X20
  MISC_FEATURE (20)..(20): Xaa can be any amino acid residue.
QTDGCGPCFTTDANMARKCXECCGGNGKCFGPQCLCNRE

SEQ ID NO: 489 - protein, 39 aa, Artificial Sequence
  CI channel peptide inhibitor sequence - Bm12b-A20
QTDGCGPCFTTDANMARKCAECCGGNGKCFGPQCLCNRE

SEQ ID NO: 490 - protein, 39 aa, Artificial Sequence
  CI channel peptide inhibitor sequence - Bm-12b-X28
  MISC_FEATURE (28)..(28): Xaa can be any amino acid residue.
QTDGCGPCFTTDANMARKCRECCGGNGXCFGPQCLCNRE

SEQ ID NO: 491 - protein, 39 aa, Artificial Sequence
  CI channel peptide inhibitor sequence - Bm-12b-A28
QTDGCGPCFTTDANMARKCRECCGGNGACFGPQCLCNRE

SEQ ID NO: 492 - protein, 39 aa, Artificial Sequence
  CI channel peptide inhibitor sequence - Bm-12b-X38
  MISC_FEATURE (38)..(38): Xaa can be any amino acid residue.
QTDGCGPCFTTDANMARKCRECCGGNGKCFGPQCLCNXE

SEQ ID NO: 493 - protein, 39 aa, Artificial Sequence
  CI channel peptide inhibitor sequence - Bm-12b-A38
QTDGCGPCFTTDANMARKCRECCGGNGKCFGPQCLCNAE

SEQ ID NO: 494 - protein, 35 aa, Artificial Sequence
  Kv2.1 peptide inhibitor sequence - HaTx1
ECRYLFGGCKTTSDCCKHLGCKFRDKYCAWDFTFS

SEQ ID NO: 495 - protein, 35 aa, Artificial Sequence
  Kv2.1 peptide inhibitor sequence - HaTx1-X3
  MISC_FEATURE (3)..(3): Xaa can be any amino acid residue.
ECXYLFGGCKTTSDCCKHLGCKFRDKYCAWDFTFS

SEQ ID NO: 496 - protein, 35 aa, Artificial Sequence
  Kv2.1 peptide inhibitor sequence - HaTx1-A3
ECAYLFGGCKTTSDCCKHLGCKFRDKYCAWDFTFS

SEQ ID NO: 497 - protein, 35 aa, Artificial Sequence
  Kv2.1 peptide inhibitor sequence - HaTx1-X10
  MISC_FEATURE (10)..(10): Xaa can be any amino acid residue.
ECRYLFGGCXTTSDCCKHLGCKFRDKYCAWDFTFS

SEQ ID NO: 498 - protein, 35 aa, Artificial Sequence
  Kv2.1 peptide inhibitor sequence - HaTx1-A10
ECRYLFGGCATTSDCCKHLGCKFRDKYCAWDFTFS

SEQ ID NO: 499 - protein, 35 aa, Artificial Sequence
  Kv2.1 peptide inhibitor sequence - HaTx1-X17
  MISC_FEATURE (17)..(17): Xaa can be any amino acid residue.
ECRYLFGGCKTTSDCCXHLGCKFRDKYCAWDFTFS

SEQ ID NO: 500 - protein, 35 aa, Artificial Sequence
  Kv2.1 peptide inhibitor sequence - HaTx1-A17
ECRYLFGGCKTTSDCCAHLGCKFRDKYCAWDFTFS

SEQ ID NO: 501 - protein, 35 aa, Artificial Sequence
  Kv2.1 peptide inhibitor sequence - HaTx1-X22
  MISC_FEATURE (22)..(22): Xaa can be any amino acid residue.
ECRYLFGGCKTTSDCCKHLGCXFRDKYCAWDFTFS

SEQ ID NO: 502 - protein, 35 aa, Artificial Sequence
  Kv2.1 peptide inhibitor sequence - HaTx1-A22
ECRYLFGGCKTTSDCCKHLGCAFRDKYCAWDFTFS

SEQ ID NO: 503 - protein, 35 aa, Artificial Sequence
  Kv2.1 peptide inhibitor sequence - HaTx1-X24
  MISC_FEATURE (24)..(24): Xaa can be any amino acid residue.
ECRYLFGGCKTTSDCCKHLGCKFXDKYCAWDFTFS

SEQ ID NO: 504 - protein, 35 aa, Artificial Sequence
  Kv2.1 peptide inhibitor sequence - HaTx1-A24
ECRYLFGGCKTTSDCCKHLGCKFADKYCAWDFTFS

SEQ ID NO: 505 - protein, 35 aa, Artificial Sequence
  Kv2.1 peptide inhibitor sequence - HaTx1-X26
  MISC_FEATURE (26)..(26): Xaa can be any amino acid residue.
ECRYLFGGCKTTSDCCKHLGCKFRDXYCAWDFTFS

SEQ ID NO: 506 - protein, 35 aa, Artificial Sequence
  Kv2.1 peptide inhibitor sequence - HaTx1-A26
ECRYLFGGCKTTSDCCKHLGCKFRDAYCAWDFTFS

SEQ ID NO: 507 - protein, 31 aa, Artificial Sequence
  Kv4.3 & Kv4.2 peptide inhibitor sequence - PaTx2-X4
  MISC_FEATURE (4)..(4): Xaa can be any amino acid residue.
YCQXWMWTCDEERKCCEGLVCRLWCKRIINM

SEQ ID NO: 508 - protein, 31 aa, Artificial Sequence
  Kv4.3 & Kv4.2 peptide inhibitor sequence - PaTx2-A4
YCQAWMWTCDEERKCCEGLVCRLWCKRIINM

SEQ ID NO: 509 - protein, 31 aa, Artificial Sequence
  Kv4.3 & Kv4.2 peptide inhibitor sequence - PaTx2-X13
  MISC_FEATURE (13)..(13): Xaa can be any amino acid residue.
YCQKWMWTCDEEXKCCEGLVCRLWCKRIINM

SEQ ID NO: 510 - protein, 31 aa, Artificial Sequence
  Kv4.3 & Kv4.2 peptide inhibitor sequence - PaTx2-A13
YCQKWMWTCDEEAKCCEGLVCRLWCKRIINM

SEQ ID NO: 511 - protein, 31 aa, Artificial Sequence
  Kv4.3 & Kv4.2 peptide inhibitor sequence - PaTx2-X14
  MISC_FEATURE (14)..(14): Xaa can be any amino acid residue.
YCQKWMWTCDEERXCCEGLVCRLWCKRIINM

SEQ ID NO: 512 - protein, 31 aa, Artificial Sequence
  Kv4.3 & Kv4.2 peptide inhibitor sequence - PaTx2-A14
YCQKWMWTCDEERACCEGLVCRLWCKRIINM

SEQ ID NO: 513 - protein, 31 aa, Artificial Sequence
  Kv4.3 & Kv4.2 peptide inhibitor sequence - PaTx2-X22
  MISC_FEATURE (22)..(22): Xaa can be any amino acid residue.
YCQKWMWTCDEERKCCEGLVCXLWCKRIINM

SEQ ID NO: 514 - protein, 31 aa, Artificial Sequence
  Kv4.3 & Kv4.2 peptide inhibitor sequence - PaTx2-A22
YCQKWMWTCDEERKCCEGLVCALWCKRIINM

SEQ ID NO: 515 - protein, 31 aa, Artificial Sequence
  Kv4.3 & Kv4.2 peptide inhibitor sequence - PaTx2-X26
  MISC_FEATURE (26)..(26): Xaa can be any amino acid residue.
YCQKWMWTCDEERKCCEGLVCRLWCXRIINM

SEQ ID NO: 516 - protein, 31 aa, Artificial Sequence
  Kv4.3 & Kv4.2 peptide inhibitor sequence - PaTx2-A26
YCQKWMWTCDEERKCCEGLVCRLWCARIINM

SEQ ID NO: 517 - protein, 31 aa, Artificial Sequence
  Kv4.3 & Kv4.2 peptide inhibitor sequence - PaTx2-X27
  MISC_FEATURE (27)..(27): Xaa can be any amino acid residue.
YCQKWMWTCDEERKCCEGLVCRLWCKXIINM

SEQ ID NO: 518 - protein, 31 aa, Artificial Sequence
  Kv4.3 & Kv4.2 peptide inhibitor sequence - PaTx2-A27
YCQKWMWTCDEERKCCEGLVCRLWCKAIINM

SEQ ID NO: 519 - protein, 16 aa, Artificial Sequence
  nACHR channel peptide inhibitor sequence - PnIA
GCCSLPPCAANNPDYC

SEQ ID NO: 520 - protein, 16 aa, Artificial Sequence
  nACHR channel peptide inhibitor sequence - PnIA-L10
GCCSLPPCALNNPDYC

SEQ ID NO: 521 - protein, 16 aa, Artificial Sequence
  nACHR channel peptide inhibitor sequence - PnIA-S11
GCCSLPPCAASNPDYC

SEQ ID NO: 522 - protein, 16 aa, Artificial Sequence
  nACHR channel peptide inhibitor sequence - PnIB
GCCSLPPCALSNPDYC

SEQ ID NO: 523 - protein, 16 aa, Artificial Sequence
  nACHR channel peptide inhibitor sequence - PnIB-A10
GCCSLPPCAASNPDYC

SEQ ID NO: 524 - protein, 16 aa, Artificial Sequence
  nACHR channel peptide inhibitor sequence - PnIB-N11
GCCSLPPCALNNPDYC

SEQ ID NO: 525 - protein, 16 aa, Artificial Sequence
  nACHR channel peptide inhibitor sequence - MII
GCCSNPVCHLEHSNLC

SEQ ID NO: 526 - protein, 14 aa, Artificial Sequence
  nACHR channel peptide inhibitor sequence - alpha-MI
GRCCHPACGKNYSC

SEQ ID NO: 527 - protein, 18 aa, Artificial Sequence
  nACHR channel peptide inhibitor sequence - alpha-EI
  MISC_FEATURE (3)..(3): Xaa is hydroxyproline.
RDXCCYHPTCNMSNPQIC

SEQ ID NO: 528 - protein, 15 aa, Artificial Sequence
  nACHR channel peptide inhibitor sequence - alpha-AuIB
GCCSYPPCFATNPDC

SEQ ID NO: 529 - protein, 18 aa, Artificial Sequence
  nACHR channel peptide inhibitor sequence - alpha-PIA
RDPCCSNPVCTVHNPQIC

SEQ ID NO: 530 - protein, 12 aa, Artificial Sequence
  nACHR channel peptide inhibitor sequence - alpha-ImI
GCCSDPRCAWRC

SEQ ID NO: 531 - protein, 12 aa, Artificial Sequence
  nACHR channel peptide inhibitor sequence - alpha-ImII
ACCSDRRCRWRC

SEQ ID NO: 532 - protein, 13 aa, Artificial Sequence
  nACHR channel peptide inhibitor sequence - alpha-GI
ECCNPACGRHYSC

SEQ ID NO: 533 - protein, 25 aa, Artificial Sequence
  nACHR channel peptide inhibitor sequence - alphaA-PIVA
  MISC_FEATURE (7)..(7): Xaa is hydroxyproline in positions 7, 13, and 20.
  MISC_FEATURE (13)..(13): Xaa is hydroxyproline in positions 7, 13, and 20.
  MISC_FEATURE (20)..(20): Xaa is hydroxyproline in positions 7, 13, and 20.
GCCGSYXNAACHXCSCKDRXSYCGQ

SEQ ID NO: 534 - protein, 29 aa, Artificial Sequence
  nACHR channel peptide inhibitor sequence - alphaA-EIVA
  MISC_FEATURE (6)..(6): Xaa is hydroxyproline in positons 6, 12, 20, 21, and 26.
  MISC_FEATURE (12)..(12): Xaa is hydroxyproline in positons 6, 12, 20, 21, and 26.
  MISC_FEATURE (20)..(20): Xaa is hydroxyproline in positons 6, 12, 20, 21, and 26.
  MISC_FEATURE (21)..(21): Xaa is hydroxyproline in positons 6, 12, 20, 21, and 26.
  MISC_FEATURE (26)..(26): Xaa is hydroxyproline in positons 6, 12, 20, 21, and 26.
GCCPYXNAACHXCGCKVGRXXYCDRXSGG

SEQ ID NO: 535 - protein, 24 aa, Artificial Sequence
  nACHR channel peptide inhibitor sequence - psi-PIIIE
  MISC_FEATURE (2)..(2): Xaa is hydroxyproline in positions 2, 3, and 14.
  MISC_FEATURE (3)..(3): Xaa is hydroxyproline in positions 2, 3, and 14.
  MISC_FEATURE (14)..(14): Xaa is hydroxyproline in positions 2, 3, and 14.
HXXCCLYGKCRRYXGCSSASCCQR

SEQ ID NO: 536 - protein, 16 aa, Artificial Sequence
  nACHR channel peptide inhibitor sequence - EpI
GCCSDPRCNMNNPDYC

SEQ ID NO: 537 - protein, 16 aa, Artificial Sequence
  nACHR channel peptide inhibitor sequence - GIC
GCCSHPACAGNNQHIC

SEQ ID NO: 538 - protein, 19 aa, Artificial Sequence
  nACHR channel peptide inhibitor sequence - GID
  MISC_FEATURE (4)..(4): Xaa in position 4 is gamma carboxy glutamic acid.
  MISC_FEATURE (16)..(16): Xaa in position 16 is hydroxyproline.
IRDXCCSNPACRVNNXHVC

SEQ ID NO: 539 - protein, 17 aa, Artificial Sequence
  nACHR channel peptide inhibitor sequence - AnIB
GGCCSHPACAANNQDYC

SEQ ID NO: 540 - protein, 16 aa, Artificial Sequence
  nACHR channel peptide inhibitor sequence - AuIA
GCCSYPPCFATNSDYC

SEQ ID NO: 541 - protein, 16 aa, Artificial Sequence
  nACHR channel peptide inhibitor sequence - AuIC
GCCSYPPCFATNSGYC

SEQ ID NO: 542 - protein, 74 aa, Heteractis magnifica
  MISC_FEATURE: The HmK peptide toxin sequence shows the immature precursor peptide.  The mature HmK peptide toxin would be predicted to be 35 amino acids in length and span residues 40 through 74.
MKSQMIAAVLLIAFCLCVVVTARMELQDVEDMENGFQKRRTCKDLIPVSECTDIRCRTSMKYRLNLCRKTCGSC

SEQ ID NO: 543 - protein, 74 aa, Heteractis magnifica; identical to SEQ ID NO: 542
  DISULFID (42)..(74): With predicted disulfide linkages between 47-74, 51-67, and 56-71.
  DISULFID (51)..(67): With predicted disulfide linkages between 47-74, 51-67, and 56-71.
  DISULFID (56)..(71): With predicted disulfide linkages between 47-74, 51-67, and 56-71.

SEQ ID NO: 544 - protein, 36 aa, Actinia equina; identical to SEQ ID NO: 7
  DISULFID (2)..(36): With predicted disulfide linkages between 2-36, 11-29, and 20-33.
  DISULFID (11)..(29): With predicted disulfide linkages between 2-36, 11-29, and 20-33.
  DISULFID (20)..(33): With predicted disulfide linkages between 2-36, 11-29, and 20-33.

SEQ ID NO: 545 - protein, 36 aa, Anemonia sulcata; identical to SEQ ID NO: 8
  DISULFID (2)..(36): With predicted disulfide linkages between 2-36, 11-29, and 20-33.
  DISULFID (11)..(29): With predicted disulfide linkages between 2-36, 11-29, and 20-33.
  DISULFID (20)..(33): With predicted disulfide linkages between 2-36, 11-29, and 20-33.

SEQ ID NO: 546 - protein, 37 aa, Bunodosoma granulifera; identical to SEQ ID NO: 9
  DISULFID (2)..(37): With predicted disulfide linkages between 2-37, 11-30, and 20-34.
  DISULFID (11)..(30): With predicted disulfide linkages between 2-37, 11-30, and 20-34.
  DISULFID (20)..(34): With predicted disulfide linkages between 2-37, 11-30, and 20-34.

SEQ ID NO: 547 - protein, 59 aa, Artificial Sequence
  Modified form of the peptide ChTx-Lg2
  MISC_FEATURE: The CHTx-Lg2 sequence shows the immature or modified form of the peptide.
MKILSVLLLALIICSIIDWSEGQFTQESCTASNQCWSICKRLHNTNRGKCMNKKCRCYS

SEQ ID NO: 548 - protein, 35 aa, Artificial Sequence
  ShK peptide sequence - ShK-Y1
YSCIDTIPKSRCTAFQCKHSMKYRLSFCRKTCGTC

SEQ ID NO: 549 - protein, 35 aa, Artificial Sequence
  ShK peptide sequence - ShK-K1
KSCIDTIPKSRCTAFQCKHSMKYRLSFCRKTCGTC

SEQ ID NO: 550 - protein, 35 aa, Artificial Sequence
  ShK peptide sequence - ShK-H1.
HSCIDTIPKSRCTAFQCKHSMKYRLSFCRKTCGTC

SEQ ID NO: 551 - protein, 35 aa, Artificial Sequence
  ShK peptide sequence - ShK-Q1.
QSCIDTIPKSRCTAFQCKHSMKYRLSFCRKTCGTC

SEQ ID NO: 552 - protein, 37 aa, Artificial Sequence
  ShK peptide sequence - PP-ShK.
PPRSCIDTIPKSRCTAFQCKHSMKYRLSFCRKTCGTC

SEQ ID NO: 553 - protein, 36 aa, Artificial Sequence
  ShK peptide sequence - M-ShK.
MRSCIDTIPKSRCTAFQCKHSMKYRLSFCRKTCGTC

SEQ ID NO: 554 - protein, 36 aa, Artificial Sequence
  ShK peptide sequence - G-ShK.
GRSCIDTIPKSRCTAFQCKHSMKYRLSFCRKTCGTC

SEQ ID NO: 555 - protein, 35 aa, Artificial Sequence
  ShK peptide sequence - ShK-K1/A22.
YSCIDTIPKSRCTAFQCKHSMAYRLSFCRKTCGTC

SEQ ID NO: 556 - protein, 35 aa, Artificial Sequence
  ShK peptide sequence - ShK-K1/A22.
KSCIDTIPKSRCTAFQCKHSMAYRLSFCRKTCGTC

SEQ ID NO: 557 - protein, 35 aa, Artificial Sequence
  ShK peptide sequence - ShK-H1/A22
HSCIDTIPKSRCTAFQCKHSMAYRLSFCRKTCGTC

SEQ ID NO: 558 - protein, 35 aa, Artificial Sequence
  ShK peptide sequence - ShK-Q1/A22.
QSCIDTIPKSRCTAFQCKHSMAYRLSFCRKTCGTC

SEQ ID NO: 559 - protein, 37 aa, Artificial Sequence
  ShK peptide sequence - PP-ShK-A22.
PPRSCIDTIPKSRCTAFQCKHSMAYRLSFCRKTCGTC

SEQ ID NO: 560 - protein, 36 aa, Artificial Sequence
  ShK peptide sequence - M-ShK-A22.
MRSCIDTIPKSRCTAFQCKHSMAYRLSFCRKTCGTC

SEQ ID NO: 561 - protein, 36 aa, Artificial Sequence
  ShK peptide sequence - G-ShK-A22.
GRSCIDTIPKSRCTAFQCKHSMAYRLSFCRKTCGTC

SEQ ID NO: 562 - protein, 38 aa, Artificial Sequence; identical to SEQ ID NO: 297
  OSK1 peptide sequence - Ac-OSK1-P12,K16,D20
  MOD_RES (1)..(1): ACETYLATION

SEQ ID NO: 563 - protein, 38 aa, Artificial Sequence; identical to SEQ ID NO: 297
  OSK1 peptide sequence - OSK1-P12,K16,D20-NH2
  MOD_RES (38)..(38): AMIDATION

SEQ ID NO: 564 - protein, 38 aa, Artificial Sequence; identical to SEQ ID NO: 297
  OSK1 peptide sequence - Ac-OSK1-P12,K16,D20-NH2.
  MOD_RES (1)..(1): ACETYLATION
  MOD_RES (38)..(38): AMIDATION

SEQ ID NO: 565 - protein, 38 aa, Artificial Sequence; identical to SEQ ID NO: 298
  OSK1 peptide sequence - OSK1-K16,D20,Y36-NH2.
  MOD_RES (38)..(38): AMIDATION

SEQ ID NO: 566 - protein, 38 aa, Artificial Sequence; identical to SEQ ID NO: 298
  OSK1 peptide sequence - Ac-OSK1-K16,D20,Y36
  MOD_RES (1)..(1): ACETYLATION

SEQ ID NO: 567 - protein, 38 aa, Artificial Sequence; identical to SEQ ID NO: 298
  OSK1 peptide sequence - Ac-OSK1-K16,D20,Y36-NH2
  MOD_RES (1)..(1): ACETYLATION
  MOD_RES (38)..(38): AMIDATION

SEQ ID NO: 568 - protein, 38 aa, Artificial Sequence; identical to SEQ ID NO: 294
  OSK1 peptide sequence - OSK1-K16-NH2
  MOD_RES (38)..(38): AMIDATION

SEQ ID NO: 569 - protein, 38 aa, Artificial Sequence; identical to SEQ ID NO: 294
  OSK1 peptide sequence - Ac-OSK1-K16.
  MOD_RES (1)..(1): ACETYLATION

SEQ ID NO: 570 - protein, 38 aa, Artificial Sequence; identical to SEQ ID NO: 294
  OSK1 peptide sequence - Ac-OSK1-K16-NH2
  MOD_RES (1)..(1): ACETYLATION
  MOD_RES (38)..(38): AMIDATION

SEQ ID NO: 571 - protein, 38 aa, Artificial Sequence; identical to SEQ ID NO: 295
  OSK1 peptide sequence - Ac-OSK1-D20.
  MOD_RES (1)..(1): ACETYLATION

SEQ ID NO: 572 - protein, 38 aa, Artificial Sequence; identical to SEQ ID NO: 295
  OSK1 peptide sequence - OSK1-D20-NH2
  MOD_RES (38)..(38): AMIDATION

SEQ ID NO: 573 - protein, 38 aa, Artificial Sequence; identical to SEQ ID NO: 295
  OSK1 peptide sequence - Ac-OSK1-D20-NH2
  MOD_RES (1)..(1): ACETYLATION
  MOD_RES (38)..(38): AMIDATION

SEQ ID NO: 574 - protein, 38 aa, Artificial Sequence; identical to SEQ ID NO: 25
  OSK1 peptide sequence - OSK1-NH2
  MOD_RES (38)..(38): AMIDATION

SEQ ID NO: 575 - protein, 38 aa, Artificial Sequence; identical to SEQ ID NO: 25
  OSK1 peptide sequence - Ac-OSK1
  MOD_RES (1)..(1): ACETYLATION

SEQ ID NO: 576 - protein, 38 aa, Artificial Sequence; identical to SEQ ID NO: 25
  OSK1 peptide sequence - Ac-OSK1-NH2
  MOD_RES (1)..(1): ACETYLATION
  MOD_RES (38)..(38): AMIDATION

SEQ ID NO: 577 - protein, 38 aa, Artificial Sequence; identical to SEQ ID NO: 296
  OSK1-peptide sequence - OSK1-K16,D20-NH2
  MOD_RES (38)..(38): AMIDATION

SEQ ID NO: 578 - protein, 38 aa, Artificial Sequence; identical to SEQ ID NO: 296
  OSK1 peptide sequence - Ac-OSK1-K16,D20
  MOD_RES (1)..(1): ACETYLATION

SEQ ID NO: 579 - protein, 38 aa, Artificial Sequence; identical to SEQ ID NO: 296
  OSK1 peptide sequence - Ac-OSK1-K16,D20-NH2
  MOD_RES (1)..(1): ACETYLATION
  MOD_RES (38)..(38): AMIDATION

SEQ ID NO: 580 - protein, 37 aa, Artificial Sequence
  OSK1 peptide sequence - Delta1-OSK1.
VIINVKCKISRQCLEPCKKAGMRFGKCMNGKCHCTPK

SEQ ID NO: 581 - protein, 37 aa, Artificial Sequence; identical to SEQ ID NO: 580
  OSK1 peptide sequence - Ac-Delta1-OSK1.
  MOD_RES (1)..(1): ACETYLATION

SEQ ID NO: 582 - protein, 37 aa, Artificial Sequence; identical to SEQ ID NO: 580
  OSK1 peptide sequence - Delta1-OSK1-NH2.
  MOD_RES (37)..(37): AMIDATION

SEQ ID NO: 583 - protein, 37 aa, Artificial Sequence; identical to SEQ ID NO: 580
  OSK1 peptide sequence - Ac-Delta1-OsK1-NH2
  MOD_RES (1)..(1): ACETYLATION
  MOD_RES (37)..(37): AMIDATION

SEQ ID NO: 584 - protein, 38 aa, Artificial Sequence
  OSK1 peptide sequence - OSK1-A34.
GVIINVKCKISRQCLEPCKKAGMRFGKCMNGKCACTPK

SEQ ID NO: 585 - protein, 38 aa, Artificial Sequence; identical to SEQ ID NO: 584
  OSK1 peptide sequence - Ac-OSK1-A34.
  MOD_RES (1)..(1): ACETYLATION

SEQ ID NO: 586 - protein, 38 aa, Artificial Sequence; identical to SEQ ID NO: 584
  OSK1 peptide sequence - OSK1-A34-NH2
  MOD_RES (38)..(38): AMIDATION

SEQ ID NO: 587 - protein, 38 aa, Artificial Sequence; identical to SEQ ID NO: 584
  OSK1 peptide sequence - Ac-OSK1-A34-NH2
  MOD_RES (1)..(1): ACETYLATION
  MOD_RES (38)..(38): AMIDATION

SEQ ID NO: 588 - protein, 37 aa, Artificial Sequence
  OSK1 peptide sequence - Delta1-OSK1-K16,D20
VIINVKCKISRQCLKPCKDAGMRFGKCMNGKCHCTPK

SEQ ID NO: 589 - protein, 37 aa, Artificial Sequence; identical to SEQ ID NO: 588
  OSK1 peptide sequence - Ac-Delta1-OSK1-K16,D20
  MOD_RES (1)..(1): ACETYLATION

SEQ ID NO: 590 - protein, 37 aa, Artificial Sequence; identical to SEQ ID NO: 588
  OSK1 peptide sequence - Delta1-OSK1-K16,D20-NH2
  MOD_RES (37)..(37): AMIDATION

SEQ ID NO: 591 - protein, 37 aa, Artificial Sequence; identical to SEQ ID NO: 588
  OSK1 peptide sequence - Ac-Delta1-OSK1-K16,D20-NH2
  MOD_RES (1)..(1): ACETYLATION
  MOD_RES (37)..(37): AMIDATION

SEQ ID NO: 592 - protein, 34 aa, Artificial Sequence
  OSK1 peptide sequence - (Delta1-4)-OSD1-K16,D20.
NVKCKISRQCLKPCKDAGMRFGKCMNGKCHCTPK

SEQ ID NO: 593 - protein, 34 aa, Artificial Sequence; identical to SEQ ID NO: 592
  OSK1 peptide sequence - Ac-(Delta1-4)-OSK1-K16,D20.
  MOD_RES (1)..(1): ACETYLATION

SEQ ID NO: 594 - protein, 34 aa, Artificial Sequence; identical to SEQ ID NO: 592
  OSK1 peptide sequence - (Delta1-4)-OSK1-K16,D20-NH2.
  MOD_RES (34)..(34): AMIDATION

SEQ ID NO: 595 - protein, 34 aa, Artificial Sequence; identical to SEQ ID NO: 592
  OSK1 peptide sequences - Ac-(Delta1-4)-OSK1-K16,D20-NH2
  MOD_RES (1)..(1): ACETYLATION
  MOD_RES (34)..(34): AMIDATION

SEQ ID NO: 596 - protein, 32 aa, Artificial Sequence
  OSK1 peptide sequence - (Delta1-6)-OSK1-K16,D20.
KCKISRQCLKPCKDAGMRFGKCMNGKCHCTPK

SEQ ID NO: 597 - protein, 32 aa, Artificial Sequence; identical to SEQ ID NO: 596
  OSK1-peptide sequence - Ac-(Delta1-6)-OSK1-K16,D20.
  MOD_RES (1)..(1): ACETYLATION

SEQ ID NO: 598 - protein, 32 aa, Artificial Sequence; identical to SEQ ID NO: 596
  OSK1 peptide sequence - (Delta1-6)-OSK1-K16,D20-NH2
  MOD_RES (32)..(32): AMIDATION

SEQ ID NO: 599 - protein, 32 aa, Artificial Sequence; identical to SEQ ID NO: 596
  OSK1 peptide sequence - Ac-(Delta1-6)-OSK1-K16,D20-NH2
  MOD_RES (1)..(1): ACETYLATION
  MOD_RES (32)..(32): AMIDATION

SEQ ID NO: 600 - protein, 31 aa, Artificial Sequence
  OSK1 peptide sequence - (Delta1-7)-OSK1-K16,D20
CKISRQCLKPCKDAGMRFGKCMNGKCHCTPK

SEQ ID NO: 601 - protein, 31 aa, Artificial Sequence; identical to SEQ ID NO: 600
  OSK1 peptide sequence - Ac-(Delta1-7)-OSK1-K16,D20
  MOD_RES (1)..(1): ACETYLATION

SEQ ID NO: 602 - protein, 31 aa, Artificial Sequence; identical to SEQ ID NO: 600
  OSK1 peptide sequence - (Delta1-7)-OSK1-K16,D20-NH2
  MOD_RES (31)..(31): AMIDATION

SEQ ID NO: 603 - protein, 31 aa, Artificial Sequence; identical to SEQ ID NO: 600
  OSK1 peptide sequence - Ac-(Delta1-7)-OSK1-K16,D20-NH2
  MOD_RES (1)..(1): ACETYLATION
  MOD_RES (31)..(31): AMIDATION

SEQ ID NO: 604 - protein, 38 aa, Artificial Sequence
  OSK1 peptide sequences - OSK1-K16,D20,N25
GVIINVKCKISRQCLKPCKDAGMRNGKCMNGKCHCTPK

SEQ ID NO: 605 - protein, 38 aa, Artificial Sequence; identical to SEQ ID NO: 604
  OSK1 peptide sequence - OSK1-K16,D20,N25-NH2
  MOD_RES (38)..(38): AMIDATION

SEQ ID NO: 606 - protein, 38 aa, Artificial Sequence; identical to SEQ ID NO: 604
  OSK1 peptide sequence - Ac-OSK1-K16,D20,N25
  MOD_RES (1)..(1): ACETYLATION

SEQ ID NO: 607 - protein, 38 aa, Artificial Sequence; identical to SEQ ID NO: 604
  OSK1 peptide sequence - Ac-OSK1-K16,D20,N25-NH2
  MOD_RES (1)..(1): ACETYLATION
  MOD_RES (38)..(38): AMIDATION

SEQ ID NO: 608 - protein, 38 aa, Artificial Sequence
  OSK1 peptide sequence - OSK1-K16,D20,R31
GVIINVKCKISRQCLKPCKDAGMRFGKCMNRKCHCTPK

SEQ ID NO: 609 - protein, 38 aa, Artificial Sequence; identical to SEQ ID NO: 608
  OSK1 peptide sequences - OsK1-K16,D20,R31-NH2
  MOD_RES (38)..(38): AMIDATION

SEQ ID NO: 610 - protein, 38 aa, Artificial Sequence; identical to SEQ ID NO: 608
  OSK1 peptide sequence - Ac-OSK1-K16,D20,R31
  MOD_RES (1)..(1): ACETYLATION

SEQ ID NO: 611 - protein, 38 aa, Artificial Sequence; identical to SEQ ID NO: 608
  OSK1 peptide sequence - Ac-OSK1-K16,D20,R31-NH2
  MOD_RES (1)..(1): ACETYLATION
  MOD_RES (38)..(38): AMIDATION

SEQ ID NO: 612 - protein, 38 aa, Artificial Sequence
  OSK1 peptide sequence - OSK1-K12,K16,R19,D20
GVIINVKCKISKQCLKPCRDAGMRFGKCMNGKCHCTPK

SEQ ID NO: 613 - protein, 38 aa, Artificial Sequence; identical to SEQ ID NO: 612
  OSK1 peptide sequence - Ac-OSK1-K12,K16,R19,D20
  MOD_RES (1)..(1): ACETYLATION

SEQ ID NO: 614 - protein, 38 aa, Artificial Sequence; identical to SEQ ID NO: 612
  OSK1 peptide sequences - OSK1-K12,K16,R19,D20,NH2
  MOD_RES (38)..(38): AMIDATION

SEQ ID NO: 615 - protein, 38 aa, Artificial Sequence; identical to SEQ ID NO: 612
  OSK1 peptide sequence - Ac-OSK1-K12,K16,R19, D20-NH2
  MOD_RES (1)..(1): ACETYLATION
  MOD_RES (38)..(38): AMIDATION

SEQ ID NO: 616 - protein, 37 aa, Artificial Sequence
  OSK1 peptide sequence - Delta1-OSK1-T2,K16,D20
TIINVKCKISRQCLKPCKDAGMRFGKCMNGKCHCTPK

SEQ ID NO: 617 - protein, 37 aa, Artificial Sequence; identical to SEQ ID NO: 616
  OSK1 peptide sequence - Ac-Delta1-OSK1-T2,K16,D20
  MOD_RES (1)..(1): ACETYLATION

SEQ ID NO: 618 - protein, 37 aa, Artificial Sequence; identical to SEQ ID NO: 616
  OSK1 peptide sequence - Delta1-OSK1-T2,K16,D20-NH2
  MOD_RES (37)..(37): AMIDATION

SEQ ID NO: 619 - protein, 37 aa, Artificial Sequence; identical to SEQ ID NO: 616
  OSK1 peptide sequence - Ac-Delta1-OSK1-T2,K16,D20-NH2
  MOD_RES (1)..(1): ACETYLATION
  MOD_RES (37)..(37): AMIDATION

SEQ ID NO: 620 - protein, 38 aa, Artificial Sequence
  OSK1 peptide sequences - OSK1-K3
GVKINVKCKISRQCLEPCKKAGMRFGKCMNGKCHCTPK

SEQ ID NO: 621 - protein, 38 aa, Artificial Sequence; identical to SEQ ID NO: 620
  OSK1 peptide sequence - Ac-OSK1-K3
  MOD_RES (1)..(1): ACETYLATION

SEQ ID NO: 622 - protein, 38 aa, Artificial Sequence; identical to SEQ ID NO: 620
  OSK1 peptide sequence - OSK1-K3-NH2
  MOD_RES (38)..(38): AMIDATION

SEQ ID NO: 623 - protein, 38 aa, Artificial Sequence; identical to SEQ ID NO: 620
  OSK1 peptide sequence - AC-OSK1-K3-NH2
  MOD_RES (1)..(1): ACETYLATION
  MOD_RES (38)..(38): AMIDATION

SEQ ID NO: 624 - protein, 38 aa, Artificial Sequence
  OSK1 peptide sequence - OSK1-K3, A34
GVKINVKCKISRQCLEPCKKAGMRFGKCMNGKCACTPK

SEQ ID NO: 625 - protein, 38 aa, Artificial Sequence
  OSK1 peptide sequence - OSK1-K3, K16,D20
GVKINVKCKISRQCLKPCKDAGMRFGKCMNGKCHCTPK

SEQ ID NO: 626 - protein, 38 aa, Artificial Sequence
  OSK1 peptide sequence - OSK1-K3,K16,D20,A34
GVKINVKCKISRQCLKPCKDAGMRFGKCMNGKCACTPK

SEQ ID NO: 627 - protein, 38 aa, Artificial Sequence; identical to SEQ ID NO: 624
  OSK1 peptide sequence - Ac-OSK1-K3,A34
  MOD_RES (1)..(1): ACETYLATION

SEQ ID NO: 628 - protein, 38 aa, Artificial Sequence; identical to SEQ ID NO: 624
  OSK1 peptide sequence - OSK1-K3,A34-NH2
  MOD_RES (38)..(38): AMIDATION

SEQ ID NO: 629 - protein, 38 aa, Artificial Sequence; identical to SEQ ID NO: 624
  OSK1 peptide sequence - Ac-OSK1-K3,A34,NH2
  MOD_RES (1)..(1): ACETYLATION
  MOD_RES (38)..(38): AMIDATION

SEQ ID NO: 630 - protein, 38 aa, Artificial Sequence; identical to SEQ ID NO: 626
  OSK1 peptide sequence - Ac-OSK1-K3,K16,D20,A34
  MOD_RES (1)..(1): ACETYLATION

SEQ ID NO: 631 - protein, 38 aa, Artificial Sequence; identical to SEQ ID NO: 626
  OSK1 peptide sequence - OSK1-K3,K16,D20,A34-NH2
  MOD_RES (38)..(38): AMIDATION

SEQ ID NO: 632 - protein, 38 aa, Artificial Sequence; identical to SEQ ID NO: 626
  OSK1 peptide sequence - Ac-OSK1-K3,K16,D20,A34-NH2
  MOD_RES (1)..(1): ACETYLATION
  MOD_RES (38)..(38): AMIDATION

SEQ ID NO: 633 - protein, 38 aa, Artificial Sequence; identical to SEQ ID NO: 625
  OSK1 peptide sequence - Ac-OSK1-K3,K16,D20
  MOD_RES (1)..(1): ACETYLATION

SEQ ID NO: 634 - protein, 38 aa, Artificial Sequence; identical to SEQ ID NO: 625
  OSK1 peptide sequence - OSK1-K3,K16,D20-NH2
  MOD_RES (38)..(38): AMIDATION

SEQ ID NO: 635 - protein, 38 aa, Artificial Sequence; identical to SEQ ID NO: 625
  OSK1 peptide sequence - Ac-OSK1-K3,K16,D20-NH2
  MOD_RES (1)..(1): ACETYLATION
  MOD_RES (38)..(38): AMIDATION

SEQ ID NO: 636 - protein, 36 aa, Artificial Sequence
  OSK1 peptide sequence - Delta36-38-OSK1-K16,D20
GVIINVKCKISRQCLKPCKDAGMRFGKCMNGKCHCT

SEQ ID NO: 637 - protein, 6 aa, Artificial Sequence
  Amino acid linker sequence.
  MISC_FEATURE (1)..(1): Xaa in positions 1, 2, 4, and 5 are each independently any amino acid residue.
  MISC_FEATURE (2)..(2): Xaa in positions 1, 2, 4, and 5 are each independently any amino acid residue.
  MISC_FEATURE (4)..(4): Xaa in positions 1, 2, 4, and 5 are each independently any amino acid residue.
  MISC_FEATURE (5)..(5): Xaa in positions 1, 2, 4, and 5 are each independently any amino acid residue.
XXNXXG

SEQ ID NO: 638 - protein, 5 aa, Artificial Sequence
  L5 linker amino acid sequence.
GGGGS

SEQ ID NO: 639 - protein, 6 aa, Artificial Sequence
  Peptide linker sequence.
GGEGGG

SEQ ID NO: 640 - protein, 8 aa, Artificial Sequence
  Peptide linker sequence.
GGEEEGGG

SEQ ID NO: 641 - protein, 5 aa, Artificial Sequence
  Peptide linker sequence.
GEEEG

SEQ ID NO: 642 - protein, 4 aa, Artificial Sequence
  Peptide linker sequence.
GEEE

SEQ ID NO: 643 - protein, 6 aa, Artificial Sequence
  Peptide linker sequence.
GGDGGG

SEQ ID NO: 644 - protein, 7 aa, Artificial Sequence
  Peptide linker sequence.
GGDDDGG

SEQ ID NO: 645 - protein, 5 aa, Artificial Sequence
  Peptide linker sequence.
GDDDG

SEQ ID NO: 646 - protein, 4 aa, Artificial Sequence
  Peptide linker sequence.
GDDD

SEQ ID NO: 647 - protein, 21 aa, Artificial Sequence
  Peptide linker sequence.
GGGGSDDSDEGSDGEDGGGGS

SEQ ID NO: 648 - protein, 5 aa, Artificial Sequence
  Peptide linker sequence.
WEWEW

SEQ ID NO: 649 - protein, 5 aa, Artificial Sequence
  Peptide linker sequence.
FEFEF

SEQ ID NO: 650 - protein, 6 aa, Artificial Sequence
  Peptide linker sequence.
EEEWWW

SEQ ID NO: 651 - protein, 6 aa, Artificial Sequence
  Peptide linker sequence.
EEEFFF

SEQ ID NO: 652 - protein, 7 aa, Artificial Sequence
  Peptide linker sequence.
WWEEEWW

SEQ ID NO: 653 - protein, 7 aa, Artificial Sequence
  Peptide linker sequence.
FFEEEFF

SEQ ID NO: 654 - protein, 6 aa, Artificial Sequence
  Peptide linker sequence.
  MISC_FEATURE (1)..(1): Xaa in positions 1, 2, 4, and 5 are each independently any amino acid residue.
  MISC_FEATURE (2)..(2): Xaa in positions 1, 2, 4, and 5 are each independently any amino acid residue.
  MISC_FEATURE (4)..(4): Xaa in positions 1, 2, 4, and 5 are each independently any amino acid residue.
  MISC_FEATURE (5)..(5): Xaa in positions 1, 2, 4, and 5 are each independently any amino acid residue.
XXYXXG

SEQ ID NO: 655 - protein, 6 aa, Artificial Sequence
  Peptide linker sequence.
  MISC_FEATURE (1)..(1): Xaa in positions 1, 2, 4, and 5 are each independently any amino acid residue.
  MISC_FEATURE (2)..(2): Xaa in positions 1, 2, 4, and 5 are each independently any amino acid residue.
  MISC_FEATURE (4)..(4): Xaa in positions 1, 2, 4, and 5 are each independently any amino acid residue.
  MISC_FEATURE (5)..(5): Xaa in positions 1, 2, 4, and 5 are each independently any amino acid residue.
XXSXXG

SEQ ID NO: 656 - protein, 6 aa, Artificial Sequence
  Peptide linker sequence.
  MISC_FEATURE (1)..(1): Xaa in positions 1, 2, 4, and 5 are each independently any amino acid residue.
  MISC_FEATURE (2)..(2): Xaa in positions 1, 2, 4, and 5 are each independently any amino acid residue.
  MISC_FEATURE (4)..(4): Xaa in positions 1, 2, 4, and 5 are each independently any amino acid residue.
  MISC_FEATURE (5)..(5): Xaa in positions 1, 2, 4, and 5 are each independently any amino acid residue.
XXTXXG

SEQ ID NO: 657 - DNA, 140 bp, Artificial Sequence
  Amino acid linker
  misc_feature: Full length ShK gene linked to four glycine and one serine amino acid linker in positions 7, 8, 9, 10, and 11.
  CDS (7)..(132)
ggatccggaggaggaggaagccgcagctgcatcgacaccatccccaagagccgctgcaccgccttccagtgcaagcacagcatgaagtaccgcctgagcttctgccgcaagacctgcggcacctgctaatgagcggccgc

SEQ ID NO: 658 - protein, 40 aa, Artificial Sequence
  Synthetic Construct
GGGGSRSCIDTIPKSRCTAFQCKHSMKYRLSFCRKTCGTC

SEQ ID NO: 659 - DNA, 81 bp, Artificial Sequence
  Oligonucleotide (3632-93)
catggatccggaggaggaggaagccgcagctgcatcgacaccatccccaagagccgctgcaccgccttccagtgcaagcac

SEQ ID NO: 660 - DNA, 82 bp, Artificial Sequence
  Oligonucleotide (3632-95)
catgcggccgctcattagcaggtgccgcaggtcttgcggcagaagctcaggcggtacttcatgctgtgcttgcactggaagg

SEQ ID NO: 661 - DNA, 27 bp, Artificial Sequence
  Primer sequence [4101-57]
catggatccagctgcatcgacaccatc

SEQ ID NO: 662 - DNA, 19 bp, Artificial Sequence
  Primer sequence [3632-96]
catgcggccgctcattagc

SEQ ID NO: 663 - DNA, 31 bp, Artificial Sequence
  Primer sequence [4101-58]
catggatccggaggaggaggaagcagctgca

SEQ ID NO: 664 - DNA, 25 bp, Artificial Sequence
  Primer sequence [4101-61]
catgcggccgctcattagcaggtgc

SEQ ID NO: 665 - DNA, 76 bp, Artificial Sequence
  Primer sequence [4101-59]
catggatccgggggtgggggttctgggggtgggggttctggaggaggaggaagcggaggaggaggaagcagctgca

SEQ ID NO: 666 - DNA, 25 bp, Artificial Sequence
  Primer Sequence [4101-61]
catgcggccgctcattagcaggtgc

SEQ ID NO: 667 - DNA, 31 bp, Artificial Sequence
  PCR primer 3008-05.
ccaacacacttcgaaagacgttgatcggcac

SEQ ID NO: 668 - DNA, 34 bp, Artificial Sequence
  PCR primer 3008-06.
cacccaacaatgcatccttaaaaaaattacgccc

SEQ ID NO: 669 - DNA, 42 bp, Artificial Sequence
  4142-87:  Oligonucleotide.
tggttccggtggtggtggttcccgttcctgcatcgacaccat

SEQ ID NO: 670 - DNA, 85 bp, Artificial Sequence
  4142-88:  Oligonucleotide.
cccgaaatcccgttgcaccgctttccagtgcaaacactccatgaaataccgtctgtccttctgccgtaaaacctgcggtacctgc

SEQ ID NO: 671 - DNA, 42 bp, Artificial Sequence
  4142-89: Oligonucleotide.
cttagcaggtaccgcaggttttacggcagaaggacagacggt

SEQ ID NO: 672 - DNA, 85 bp, Artificial Sequence
  4142-90: Oligonucleotide.
atttcatggagtgtttgcactggaaagcggtgcaacgggatttcgggatggtgtcgatgcaggaacgggaaccaccaccaccgga

SEQ ID NO: 673 - DNA, 127 bp, Artificial Sequence
  Oligonucleotide duplex.
  misc_feature (1)..(4): Single-stranded DNA in position 1-4.
  CDS (2)..(127)
tggttccggtggtggtggttcccgttcctgcatcgacaccatcccgaaatcccgttgcaccgctttccagtgcaaacactccatgaaataccgtctgtccttctgccgtaaaacctgcggtacctgc

SEQ ID NO: 674 - protein, 42 aa, Artificial Sequence
  Synthetic Construct
GSGGGGSRSCIDTIPKSRCTAFQCKHSMKYRLSFCRKTCGTC

SEQ ID NO: 675 - DNA, 127 bp, Artificial Sequence
  Oligonucleotide duplex.
  misc_feature (1)..(4): Single-stranded DNA in position 1-4.
cttagcaggtaccgcaggttttacggcagaaggacagacggtatttcatggagtgtttgcactggaaagcggtgcaacgggatttcgggatggtgtcgatgcaggaacgggaaccaccaccaccgga

SEQ ID NO: 676 - DNA, 83 bp, Artificial Sequence
  4154-78:  Oligonucleotide duplex.
tggttccggtggtggtggttcctgcatcgacaccatcccgaaatcccgttgcaccgctttccagtgcaaacactccatgaaat

SEQ ID NO: 677 - DNA, 38 bp, Artificial Sequence
  4154-79: Oglionucleotide duplex.
accgtctgtccttctgccgtaaaacctgcggtacctgc

SEQ ID NO: 678 - DNA, 82 bp, Artificial Sequence
  4154-8O: Oligonucleotide duplex.
cttagcaggtaccgcaggttttacggcagaaggacagacggtatttcatggagtgtttgcactggaaagcggtgcaacggga

SEQ ID NO: 679 - DNA, 39 bp, Artificial Sequence
  4154-81: Oligonucleotide duplex.
tttcgggatggtgtcgatgcaggaaccaccaccaccgga

SEQ ID NO: 680 - DNA, 121 bp, Artificial Sequence
  Oligonucleotide duplex.
  misc_feature (1)..(4): Single-stranded DNA in positions 1-4.
  CDS (2)..(121)
tggttccggtggtggtggttcctgcatcgacaccatcccgaaatcccgttgcaccgctttccagtgcaaacactccatgaaataccgtctgtccttctgccgtaaaacctgcggtacctgc

SEQ ID NO: 681 - protein, 40 aa, Artificial Sequence
  Synthetic Construct
GSGGGGSCIDTIPKSRCTAFQCKHSMKYRLSFCRKTCGTC

SEQ ID NO: 682 - DNA, 116 bp, Artificial Sequence
  Oligonucleotide duplex.
  misc_feature (1)..(4): Single-stranded in positions 1-4.
caggtaccgcaggttttacggcagaaggacagacggtatttcatggagtgtttgcactggaaagcggtgcaacgggatttcgggatggtgtcgatgcaggaaccaccaccaccgga

SEQ ID NO: 683 - DNA, 11 bp, Artificial Sequence
  Peptide duplex
tggttgagacg

SEQ ID NO: 684 - DNA, 10 bp, Artificial Sequence
  Peptide duplex
tccaccacca

SEQ ID NO: 685 - DNA, 10 bp, Artificial Sequence
  Peptide duplex
taaggatccg

SEQ ID NO: 686 - DNA, 11 bp, Artificial Sequence
  Peptide duplex
gcagagaattc

SEQ ID NO: 687 - DNA, 11 bp, Artificial Sequence
  Peptide duplex
tatgcgagacg

SEQ ID NO: 688 - DNA, 11 bp, Artificial Sequence
  Peptide duplex
ttattgtatac

SEQ ID NO: 689 - DNA, 11 bp, Artificial Sequence
  Peptide duplex
gcagagtccac

SEQ ID NO: 690 - DNA, 42 bp, Artificial Sequence
  Oligonucleotide [4142-91]
tggttccggtggtggtggttcccgtacctgcaaagacctgat

SEQ ID NO: 691 - protein, 35 aa, Artificial Sequence
  TmTx
RCHFVVCTTDCRRNSPGTYGECVKKEKGKECVCKS

SEQ ID NO: 692 - DNA, 85 bp, Artificial Sequence
  Oligonucleotide [nt 4142-92]
cccggtttccgaatgcaccgacatccgttgccgtacctccatgaaataccgtctgaacctgtgccgtaaaacctgcggttcctgc

SEQ ID NO: 693 - DNA, 42 bp, Artificial Sequence
  Oligonucleotide [nt 4142-93]
cttagcaggaaccgcaggttttacggcacaggttcagacggt

SEQ ID NO: 694 - DNA, 85 bp, Artificial Sequence
  Oligonucleotide [nt 4142-94]
atttcatggaggtacggcaacggatgtcggtgcattcggaaaccgggatcaggtctttgcaggtacgggaaccaccaccaccgga

SEQ ID NO: 695 - DNA, 127 bp, Artificial Sequence
  Oligonucleotide duplex
  misc_feature (1)..(4): Single-stranded DNA in positions 1-4 on both strands.
  CDS (2)..(127)
tggttccggtggtggtggttcccgtacctgcaaagacctgatcccggtttccgaatgcaccgacatccgttgccgtacctccatgaaataccgtctgaacctgtgccgtaaaacctgcggttcctgc

SEQ ID NO: 696 - protein, 42 aa, Artificial Sequence
  Synthetic Construct
GSGGGGSRTCKDLIPVSECTDIRCRTSMKYRLNLCRKTCGSC

SEQ ID NO: 697 - DNA, 127 bp, Artificial Sequence
  Oligonucleotide duplex.
  misc_feature (1)..(4): Single-stranded DNA in positions 1-4.
cttagcaggaaccgcaggttttacggcacaggttcagacggtatttcatggaggtacggcaacggatgtcggtgcattcggaaaccgggatcaggtctttgcaggtacgggaaccaccaccaccgga

SEQ ID NO: 698 - DNA, 47 bp, Artificial Sequence
  Oligonucleotide duplex [4128-77]
tggttccggtggtggtggttccggtgttgaaatcaacgttaaatgct

SEQ ID NO: 699 - DNA, 89 bp, Artificial Sequence
  Oligonucleotide duplex [4128-78]
ccggttccccgcagtgcctgaaaccgtgcaaagacgctggtatgcgtttcggtaaatgcatgaaccgtaaatgccactgcaccccgaaa

SEQ ID NO: 700 - DNA, 47 bp, Artificial Sequence
  Oligonucleotide duplex [4128-79]
cttatttcggggtgcagtggcatttacggttcatgcatttaccgaaa

SEQ ID NO: 701 - DNA, 89 bp, Artificial Sequence
  Oligonucleotide duplex [4128-80]
cgcataccagcgtctttgcacggtttcaggcactgcggggaaccggagcatttaacgttgatttcaacaccggaaccaccaccaccgga

SEQ ID NO: 702 - DNA, 136 bp, Artificial Sequence
  Oligonucleotide duplex
  misc_feature (1)..(4): Single-stranded DNA in positions 1-4.
  CDS (2)..(136)
tggttccggtggtggtggttccggtgttgaaatcaacgttaaatgctccggttccccgcagtgcctgaaaccgtgcaaagacgctggtatgcgtttcggtaaatgcatgaaccgtaaatgccactgcaccccgaaa

SEQ ID NO: 703 - protein, 45 aa, Artificial Sequence
  Synthetic Construct
GSGGGGSGVEINVKCSGSPQCLKPCKDAGMRFGKCMNRKCHCTPK

SEQ ID NO: 704 - DNA, 136 bp, Artificial Sequence
  Oligonucleotide duplex
  misc_feature (1)..(4): Single-stranded DNA in positions 1-4.
cttatttcggggtgcagtggcatttacggttcatgcatttaccgaaacgcataccagcgtctttgcacggtttcaggcactgcggggaaccggagcatttaacgttgatttcaacaccggaaccaccaccaccgga

SEQ ID NO: 705 - DNA, 46 bp, Artificial Sequence
  Oligonucleotide duplex [4128-85]
tggttccggtggtggtggttccgcttcctgccgtaccccgaaagac

SEQ ID NO: 706 - DNA, 78 bp, Artificial Sequence
  Oligonucleotide duplex [4128-86]
tgcgctgacccgtgccgtaaagaaaccggttgcccgtacggtaaatgcatgaaccgtaaatgcaaatgcaaccgttgc

SEQ ID NO: 707 - DNA, 48 bp, Artificial Sequence
  Oligonucleotide duplex [4128-87]
cttagcaacggttgcatttgcatttacggttcatgcatttaccgtacg

SEQ ID NO: 708 - DNA, 76 bp, Artificial Sequence
  Oligonucleotide duplex [4128-88]
ggcaaccggtttctttacggcacgggtcagcgcagtctttcggggtacggcaggaagcggaaccaccaccaccgga

SEQ ID NO: 709 - DNA, 124 bp, Artificial Sequence
  Oligonucleotide duplex
  misc_feature (1)..(4): Single-stranded DNA in positions 1-4.
  CDS (2)..(124)
tggttccggtggtggtggttccgcttcctgccgtaccccgaaagactgcgctgacccgtgccgtaaagaaaccggttgcccgtacggtaaatgcatgaaccgtaaatgcaaatgcaaccgttgc

SEQ ID NO: 710 - protein, 41 aa, Artificial Sequence
  Synthetic Construct
GSGGGGSASCRTPKDCADPCRKETGCPYGKCMNRKCKCNRC

SEQ ID NO: 711 - DNA, 124 bp, Artificial Sequence
  Oligonucleotide duplex
  misc_feature (1)..(4): Single-stranded DNA in positions 1-4.
cttagcaacggttgcatttgcatttacggttcatgcatttaccgtacgggcaaccggtttctttacggcacgggtcagcgcagtctttcggggtacggcaggaagcggaaccaccaccaccgga

SEQ ID NO: 712 - DNA, 48 bp, Artificial Sequence
  Oligonucleotide duplex [4128-59]
tggttccggtggtggtggttccaccatcatcaacgttaaatgcacctc

SEQ ID NO: 713 - DNA, 91 bp, Artificial Sequence
  Oligonucleotide duplex [4128-60]
cccgaaacagtgcctgccgccgtgcaaagctcagttcggtcagtccgctggtgctaaatgcatgaacggtaaatgcaaatgctacccgcac

SEQ ID NO: 714 - DNA, 48 bp, Artificial Sequence
  Oligonucleotide duplex [4128-61]
cttagtgcgggtagcatttgcatttaccgttcatgcatttagcaccag

SEQ ID NO: 715 - DNA, 91 bp, Artificial Sequence
  Oligonucleotide duplex [4128-62]
cggactgaccgaactgagctttgcacggcggcaggcactgtttcggggaggtgcatttaacgttgatgatggtggaaccaccaccaccgga

SEQ ID NO: 716 - DNA, 139 bp, Artificial Sequence
  Oligonucleotide duplex
  misc_feature (1)..(4): Single-stranded DNA in positions 1-4.
  CDS (2)..(139)
tggttccggtggtggtggttccaccatcatcaacgttaaatgcacctccccgaaacagtgcctgccgccgtgcaaagctcagttcggtcagtccgctggtgctaaatgcatgaacggtaaatgcaaatgctacccgcac

SEQ ID NO: 717 - protein, 46 aa, Artificial Sequence
  Synthetic Construct
GSGGGGSTIINVKCTSPKQCLPPCKAQFGQSAGAKCMNGKCKCYPH

SEQ ID NO: 718 - DNA, 139 bp, Artificial Sequence
  Oligonucleotide duplex
  misc_feature (1)..(4): Single-stranded DNA in positions 1-4.
cttagtgcgggtagcatttgcatttaccgttcatgcatttagcaccagcggactgaccgaactgagctttgcacggcggcaggcactgtttcggggaggtgcatttaacgttgatgatggtggaaccaccaccaccgga

SEQ ID NO: 719 - DNA, 52 bp, Artificial Sequence
  Oligonucleotide duplex [4128-89]
tggttccggtggtggtggttccggtgttccgatcaacgtttcctgcaccggt

SEQ ID NO: 720 - DNA, 84 bp, Artificial Sequence
  Oligonucleotide duplex [4128-90]
tccccgcagtgcatcaaaccgtgcaaagacgctggtatgcgtttcggtaaatgcatgaaccgtaaatgccactgcaccccgaaa

SEQ ID NO: 721 - DNA, 53 bp, Artificial Sequence
  Oligonucleotide duplex [4128-91]
cttatttcggggtgcagtggcatttacggttcatgcatttaccgaaacgcata

SEQ ID NO: 722 - DNA, 83 bp, Artificial Sequence
  Oligonucleotide duplex [4128-92]
ccagcgtctttgcacggtttgatgcactgcggggaaccggtgcaggaaacgttgatcggaacaccggaaccaccaccaccgga

SEQ ID NO: 723 - DNA, 136 bp, Artificial Sequence
  Oligonucleotide duplex
  misc_feature (1)..(4): Single-stranded DNA in positions 1-4.
  CDS (2)..(136)
tggttccggtggtggtggttccggtgttccgatcaacgtttcctgcaccggttccccgcagtgcatcaaaccgtgcaaagacgctggtatgcgtttcggtaaatgcatgaaccgtaaatgccactgcaccccgaaa

SEQ ID NO: 724 - protein, 45 aa, Artificial Sequence
  Synthetic Construct
GSGGGGSGVPINVSCTGSPQCIKPCKDAGMRFGKCMNRKCHCTPK

SEQ ID NO: 725 - DNA, 136 bp, Artificial Sequence
  Oligonucleotide duplex
  misc_feature (1)..(4): Single-stranded DNA in positions 1-4.
cttatttcggggtgcagtggcatttacggttcatgcatttaccgaaacgcataccagcgtctttgcacggtttgatgcactgcggggaaccggtgcaggaaacgttgatcggaacaccggaaccaccaccaccgga

SEQ ID NO: 726 - DNA, 83 bp, Artificial Sequence
  Oligonucleotide duplex [4154-82]
tggttccggtggtggtggttccggtgttatcatcaacgttaaatgcaaaatctcccgtcagtgcctggaaccgtgcaaaaaag

SEQ ID NO: 727 - DNA, 53 bp, Artificial Sequence
  Oligonucleotide duplex [4154-83]
ctggtatgcgtttcggtaaatgcatgaacggtaaatgccactgcaccccgaaa

SEQ ID NO: 728 - DNA, 83 bp, Artificial Sequence
  Oligonucleotide duplex [4154-84]
cttatttcggggtgcagtggcatttaccgttcatgcatttaccgaaacgcataccagcttttttgcacggttccaggcactga

SEQ ID NO: 729 - DNA, 53 bp, Artificial Sequence
  Oligonucleotide duplex [4154-85]
cgggagattttgcatttaacgttgatgataacaccggaaccaccaccaccgga

SEQ ID NO: 730 - DNA, 136 bp, Artificial Sequence
  Oligonucleotide duplex
  misc_feature (1)..(4): Single-stranded DNA in positions 1-4.
  CDS (2)..(136)
tggttccggtggtggtggttccggtgttatcatcaacgttaaatgcaaaatctcccgtcagtgcctggaaccgtgcaaaaaagctggtatgcgtttcggtaaatgcatgaacggtaaatgccactgcaccccgaaa

SEQ ID NO: 731 - protein, 45 aa, Artificial Sequence
  Synthetic Construct
GSGGGGSGVIINVKCKISRQCLEPCKKAGMRFGKCMNGKCHCTPK

SEQ ID NO: 732 - DNA, 136 bp, Artificial Sequence
  Oligonucleotide duplex
  misc_feature (1)..(4): Single-stranded DNA in positions 1-4.
cttatttcggggtgcagtggcatttaccgttcatgcatttaccgaaacgcataccagcttttttgcacggttccaggcactgacgggagattttgcatttaacgttgatgataacaccggaaccaccaccaccgga

SEQ ID NO: 733 - DNA, 83 bp, Artificial Sequence
  Oligonucleotide duplex [4154-86]
tggttccggtggtggtggttccggtgttatcatcaacgttaaatgcaaaatctcccgtcagtgcctgaaaccgtgcaaagacg

SEQ ID NO: 734 - DNA, 53 bp, Artificial Sequence; identical to SEQ ID NO: 727
  Oligonucleotide duplex [4154-83]

SEQ ID NO: 735 - DNA, 83 bp, Artificial Sequence
  Oligonucleotide duplex [4154-87]
cttatttcggggtgcagtggcatttaccgttcatgcatttaccgaaacgcataccagcgtctttgcacggtttcaggcactga

SEQ ID NO: 736 - DNA, 53 bp, Artificial Sequence; identical to SEQ ID NO: 729
  Oligonucleotide duplex [4154-85]

SEQ ID NO: 737 - DNA, 136 bp, Artificial Sequence
  Oligonucleotide duplex
  misc_feature (1)..(4): Single-stranded DNA strand in position 1-4.
  CDS (2)..(136)
tggttccggtggtggtggttccggtgttatcatcaacgttaaatgcaaaatctcccgtcagtgcctgaaaccgtgcaaagacgctggtatgcgtttcggtaaatgcatgaacggtaaatgccactgcaccccgaaa

SEQ ID NO: 738 - protein, 45 aa, Artificial Sequence
  Synthetic Construct
GSGGGGSGVIINVKCKISRQCLKPCKDAGMRFGKCMNGKCHCTPK

SEQ ID NO: 739 - DNA, 136 bp, Artificial Sequence
  Oligonucleotide duplex
  misc_feature (1)..(4): Single-stranded DNA in positions 1-4.
cttatttcggggtgcagtggcatttaccgttcatgcatttaccgaaacgcataccagcgtctttgcacggtttcaggcactgacgggagattttgcatttaacgttgatgataacaccggaaccaccaccaccgga

SEQ ID NO: 740 - DNA, 83 bp, Artificial Sequence
  Oligonucleotide duplex [4154-88]
tggttccggtggtggtggttccaaagaatgcaccggtccgcagcactgcaccaacttctgccgtaaaaacaaatgcacccacg

SEQ ID NO: 741 - DNA, 41 bp, Artificial Sequence
  Oligonucleotide duplex [4154-89]
gtaaatgcatgaaccgtaaatgcaaatgcttcaactgcaaa

SEQ ID NO: 742 - DNA, 83 bp, Artificial Sequence
  Oligonucleotide duplex [4154-90]
cttatttgcagttgaagcatttgcatttacggttcatgcatttaccgtgggtgcatttgtttttacggcagaagttggtgcag

SEQ ID NO: 743 - DNA, 41 bp, Artificial Sequence
  Oligonucleotide duplex [4154-91]
tgctgcggaccggtgcattctttggaaccaccaccaccgga

SEQ ID NO: 744 - DNA, 124 bp, Artificial Sequence
  Oligonucleotide duplex
  misc_feature (1)..(4): Single-stranded DNA in positions 1-4.
  CDS (2)..(124)
tggttccggtggtggtggttccaaagaatgcaccggtccgcagcactgcaccaacttctgccgtaaaaacaaatgcacccacggtaaatgcatgaaccgtaaatgcaaatgcttcaactgcaaa

SEQ ID NO: 745 - protein, 41 aa, Artificial Sequence
  Synthetic Construct
GSGGGGSKECTGPQHCTNFCRKNKCTHGKCMNRKCKCFNCK

SEQ ID NO: 746 - DNA, 124 bp, Artificial Sequence
  Oligonucleotide duplex
  misc_feature (1)..(1): Single-stranded DNA in positions 1-4
cttatttgcagttgaagcatttgcatttacggttcatgcatttaccgtgggtgcatttgtttttacggcagaagttggtgcagtgctgcggaccggtgcattctttggaaccaccaccaccgga

SEQ ID NO: 747 - DNA, 83 bp, Artificial Sequence
  Oligonucleotide duplex [4154-92]
tggttccggtggtggtggttccaccatcatcaacgttaaatgcacctccccgaaacagtgctccaaaccgtgcaaagaactgt

SEQ ID NO: 748 - DNA, 56 bp, Artificial Sequence
  Oligonucleotide duplex [4154-93]
acggttcctccgctggtgctaaatgcatgaacggtaaatgcaaatgctacaacaac

SEQ ID NO: 749 - DNA, 83 bp, Artificial Sequence
  Oligonucleotide duplex [4154-94]
cttagttgttgtagcatttgcatttaccgttcatgcatttagcaccagcggaggaaccgtacagttctttgcacggtttggag

SEQ ID NO: 750 - DNA, 56 bp, Artificial Sequence
  Oligonucleotide duplex [4154-95]
cactgtttcggggaggtgcatttaacgttgatgatggtggaaccaccaccaccgga

SEQ ID NO: 751 - DNA, 139 bp, Artificial Sequence
  Oligonucleotide duplex
  misc_feature (1)..(4): Single-stranded DNA in positions 1-4.
  CDS (2)..(139)
tggttccggtggtggtggttccaccatcatcaacgttaaatgcacctccccgaaacagtgctccaaaccgtgcaaagaactgtacggttcctccgctggtgctaaatgcatgaacggtaaatgcaaatgctacaacaac

SEQ ID NO: 752 - protein, 46 aa, Artificial Sequence
  Synthetic Construct
GSGGGGSTIINVKCTSPKQCSKPCKELYGSSAGAKCMNGKCKCYNN

SEQ ID NO: 753 - DNA, 139 bp, Artificial Sequence
  Oligonucleotide duplex
  misc_feature (1)..(4): Single-stranded DNA in positions 1-4.
cttagttgttgtagcatttgcatttaccgttcatgcatttagcaccagcggaggaaccgtacagttctttgcacggtttggagcactgtttcggggaggtgcatttaacgttgatgatggtggaaccaccaccaccgga

SEQ ID NO: 754 - DNA, 43 bp, Artificial Sequence
  Oligonucleotide duplex [4128-81]
tggttccggtggtggtggttccaccatctcctgcaccaacccg

SEQ ID NO: 755 - DNA, 84 bp, Artificial Sequence
  Oligonucleotide duplex [4128-82]
aaacagtgctacccgcactgcaaaaaagaaaccggttacccgaacgctaaatgcatgaaccgtaaatgcaaatgcttcggtcgt

SEQ ID NO: 756 - DNA, 44 bp, Artificial Sequence
  Oligonucleotide duplex [4128-83]
cttaacgaccgaagcatttgcatttacggttcatgcatttagcg

SEQ ID NO: 757 - DNA, 83 bp, Artificial Sequence
  Oligonucleotide duplex
ttcgggtaaccggtttcttttttgcagtgcgggtagcactgtttcgggttggtgcaggagatggtggaaccaccaccaccgga

SEQ ID NO: 758 - DNA, 127 bp, Artificial Sequence
  Oligonucleotide duplex
  misc_feature (1)..(4): Single-stranded DNA in postions 1-4.
  CDS (2)..(127)
tggttccggtggtggtggttccaccatctcctgcaccaacccgaaacagtgctacccgcactgcaaaaaagaaaccggttacccgaacgctaaatgcatgaaccgtaaatgcaaatgcttcggtcgt

SEQ ID NO: 759 - protein, 42 aa, Artificial Sequence
  Synthetic Construct
GSGGGGSTISCTNPKQCYPHCKKETGYPNAKCMNRKCKCFGR

SEQ ID NO: 760 - DNA, 127 bp, Artificial Sequence
  Oligonucleotide duplex
  misc_feature (1)..(4): Single-stranded DNA in positions 1-4.
cttaacgaccgaagcatttgcatttacggttcatgcatttagcgttcgggtaaccggtttcttttttgcagtgcgggtagcactgtttcgggttggtgcaggagatggtggaaccaccaccaccgga

SEQ ID NO: 761 - DNA, 83 bp, Artificial Sequence
  Oligonucleotide [4154-96]
tatgcgttcttgtattgatactattccaaaatctcgttgtactgcttttcaatgtaaacattctatgaaatatcgtctttctt

SEQ ID NO: 762 - DNA, 44 bp, Artificial Sequence
  Oligo nucleotide [4154-97]
tttgtcgtaaaacttgtggtacttgttctggtggtggtggttct

SEQ ID NO: 763 - DNA, 83 bp, Artificial Sequence
  Oligonucleotide duplex
caccagaaccaccaccaccagaacaagtaccacaagttttacgacaaaaagaaagacgatatttcatagaatgtttacattga

SEQ ID NO: 764 - DNA, 44 bp, Artificial Sequence
  Oligonucleotide duplex [4154-99]
aaagcagtacaacgagattttggaatagtatcaatacaagaacg

SEQ ID NO: 765 - DNA, 127 bp, Artificial Sequence
  Oligonucleotide duplex
  misc_feature (1)..(4): Single-stranded DNA in positions 1-4.
  CDS (2)..(127)
tatgcgttcttgtattgatactattccaaaatctcgttgtactgcttttcaatgtaaacattctatgaaatatcgtctttctttttgtcgtaaaacttgtggtacttgttctggtggtggtggttct

SEQ ID NO: 766 - protein, 42 aa, Artificial Sequence
  Synthetic Construct
MRSCIDTIPKSRCTAFQCKHSMKYRLSFCRKTCGTCSGGGGS

SEQ ID NO: 767 - DNA, 127 bp, Artificial Sequence
  Oligonucleotide duplex
  misc_feature (1)..(4): Single-stranded DNA in positions 1-4.
caccagaaccaccaccaccagaacaagtaccacaagttttacgacaaaaagaaagacgatatttcatagaatgtttacattgaaaagcagtacaacgagattttggaatagtatcaatacaagaacg

SEQ ID NO: 768 - DNA, 80 bp, Artificial Sequence
  Oligonucleotide duplex [4155-01]
tatgtcttgtattgatactattccaaaatctcgttgtactgcttttcaatgtaaacattctatgaaatatcgtctttctt

SEQ ID NO: 769 - DNA, 44 bp, Artificial Sequence; identical to SEQ ID NO: 762
  Oligonucleotide duplex [4154-97]

SEQ ID NO: 770 - DNA, 83 bp, Artificial Sequence; identical to SEQ ID NO: 763
  Oligonucleotide duplex [4154-98]

SEQ ID NO: 771 - DNA, 41 bp, Artificial Sequence
  Oligonucleotide duplex [4155-02]
aaagcagtacaacgagattttggaatagtatcaatacaaga

SEQ ID NO: 772 - DNA, 124 bp, Artificial Sequence
  Oligonucleotide duplex
  misc_feature (1)..(4): Single-stranded DNA in positions 1-4.
  CDS (2)..(124)
tatgtcttgtattgatactattccaaaatctcgttgtactgcttttcaatgtaaacattctatgaaatatcgtctttctttttgtcgtaaaacttgtggtacttgttctggtggtggtggttct

SEQ ID NO: 773 - protein, 41 aa, Artificial Sequence
  Synthetic Construct
MSCIDTIPKSRCTAFQCKHSMKYRLSFCRKTCGTCSGGGGS

SEQ ID NO: 774 - DNA, 124 bp, Artificial Sequence
  Oligonucleotide duplex
  misc_feature (1)..(4): Single-stranded DNA in positions 1-4.
caccagaaccaccaccaccagaacaagtaccacaagttttacgacaaaaagaaagacgatatttcatagaatgtttacattgaaaagcagtacaacgagattttggaatagtatcaatacaaga

SEQ ID NO: 775 - DNA, 37 bp, Artificial Sequence
  Oligonucleotide duplex [4128-69]
tggttccggtggtggtggttcccagttcaccaacgtt

SEQ ID NO: 776 - DNA, 96 bp, Artificial Sequence
  Oligonucleotide duplex [4128-70]
tcctgcaccacctccaaagaatgctggtccgtttgccagcgtctgcacaacacctcccgtggtaaatgcatgaacaaaaaatgccgttgctactcc

SEQ ID NO: 777 - DNA, 38 bp, Artificial Sequence
  Oligonucleotide duplex [4128-71]
cttaggagtagcaacggcattttttgttcatgcattta

SEQ ID NO: 778 - DNA, 95 bp, Artificial Sequence
  Oligonucleotide duplex [4128-72]
ccacgggaggtgttgtgcagacgctggcaaacggaccagcattctttggaggtggtgcaggaaacgttggtgaactgggaaccaccaccaccgga

SEQ ID NO: 779 - DNA, 133 bp, Artificial Sequence
  Oligonucleotide duplex
  misc_feature (1)..(4): Single-stranded DNA in positions 1-4.
  CDS (2)..(133)
tggttccggtggtggtggttcccagttcaccaacgtttcctgcaccacctccaaagaatgctggtccgtttgccagcgtctgcacaacacctcccgtggtaaatgcatgaacaaaaaatgccgttgctactcc

SEQ ID NO: 780 - protein, 44 aa, Artificial Sequence
  Synthetic Construct
GSGGGGSQFTNVSCTTSKECWSVCQRLHNTSRGKCMNKKCRCYS

SEQ ID NO: 781 - DNA, 133 bp, Artificial Sequence
  Oligonucleotide duplex
cttaggagtagcaacggcattttttgttcatgcatttaccacgggaggtgttgtgcagacgctggcaaacggaccagcattctttggaggtggtgcaggaaacgttggtgaactgggaaccaccaccaccgga

SEQ ID NO: 782 - DNA, 37 bp, Artificial Sequence
  Oligonucleotide duplex [4128-65]
tggttccggtggtggtggttccgtttcctgcaccggt

SEQ ID NO: 783 - DNA, 87 bp, Artificial Sequence
  Oligonucleotide duplex [4128-66]
tccaaagactgctacgctccgtgccgtaaacagaccggttgcccgaacgctaaatgcatcaacaaatcctgcaaatgctacggttgc

SEQ ID NO: 784 - DNA, 38 bp, Artificial Sequence
  Oligonucleotide duplex [4128-67]
cttagcaaccgtagcatttgcaggatttgttgatgcat

SEQ ID NO: 785 - DNA, 86 bp, Artificial Sequence
  Oligonucleotide duplex [4128-68]
ttagcgttcgggcaaccggtctgtttacggcacggagcgtagcagtctttggaaccggtgcaggaaacggaaccaccaccaccgga

SEQ ID NO: 786 - DNA, 124 bp, Artificial Sequence
  Oligonucleotide duplex
  misc_feature (1)..(4): Single-stranded DNA in positions 1-4.
  CDS (2)..(124)
tggttccggtggtggtggttccgtttcctgcaccggttccaaagactgctacgctccgtgccgtaaacagaccggttgcccgaacgctaaatgcatcaacaaatcctgcaaatgctacggttgc

SEQ ID NO: 787 - protein, 41 aa, Artificial Sequence
  Synthetic Construct
GSGGGGSVSCTGSKDCYAPCRKQTGCPNAKCINKSCKCYGC

SEQ ID NO: 788 - DNA, 124 bp, Artificial Sequence
  Oligonucleotide duplex
  misc_feature (1)..(4): Single-stranded DNA in positions 1-4.
cttagcaaccgtagcatttgcaggatttgttgatgcatttagcgttcgggcaaccggtctgtttacggcacggagcgtagcagtctttggaaccggtgcaggaaacggaaccaccaccaccgga

SEQ ID NO: 789 - DNA, 42 bp, Artificial Sequence
  Oligonucleotide duplex [4128-73]
tggttccggtggtggtggttcccagttcaccaacgtttcctg

SEQ ID NO: 790 - DNA, 91 bp, Artificial Sequence
  Oligonucleotide duplex [4128-74]
caccacctccaaagaatgctggtccgtttgccagcgtctgcacaacacctcccgtggtaaatgcatgaacaaagaatgccgttgctactcc

SEQ ID NO: 791 - DNA, 43 bp, Artificial Sequence
  Oligonucleotide duplex [4128-75]
cttaggagtagcaacggcattctttgttcatgcatttaccacg

SEQ ID NO: 792 - DNA, 90 bp, Artificial Sequence
  Oligonucleotide duplex [4128-76]
ggaggtgttgtgcagacgctggcaaacggaccagcattctttggaggtggtgcaggaaacgttggtgaactgggaaccaccaccaccgga

SEQ ID NO: 793 - DNA, 133 bp, Artificial Sequence
  Oligonucleotide duplex
  misc_feature (1)..(4): Single-stranded DNA in positions 1-4.
  CDS (2)..(133)
tggttccggtggtggtggttcccagttcaccaacgtttcctgcaccacctccaaagaatgctggtccgtttgccagcgtctgcacaacacctcccgtggtaaatgcatgaacaaagaatgccgttgctactcc

SEQ ID NO: 794 - protein, 44 aa, Artificial Sequence
  Synthetic Construct
GSGGGGSQFTNVSCTTSKECWSVCQRLHNTSRGKCMNKECRCYS

SEQ ID NO: 795 - DNA, 133 bp, Artificial Sequence
  Oligonucleotide duplex
cttaggagtagcaacggcattctttgttcatgcatttaccacgggaggtgttgtgcagacgctggcaaacggaccagcattctttggaggtggtgcaggaaacgttggtgaactgggaaccaccaccaccgga

SEQ ID NO: 796 - DNA, 79 bp, Artificial Sequence
  Oligonucleotide duplex [4128-63]
tggttccggtggtggtggttcctgcaactgcaaagctccggaaaccgctctgtgcgctcgtcgttgccagcagcacggt

SEQ ID NO: 797 - DNA, 79 bp, Artificial Sequence
  Oligonucleotide duplex [4128-64]
cttaaccgtgctgctggcaacgacgagcgcacagagcggtttccggagctttgcagttgcaggaaccaccaccaccgga

SEQ ID NO: 798 - DNA, 79 bp, Artificial Sequence; identical to SEQ ID NO: 796
  Oligonucleotide duplex
  misc_feature (1)..(4): Single-stranded DNA in positions 1-4.
  CDS (2)..(79)

SEQ ID NO: 799 - protein, 26 aa, Artificial Sequence
  Synthetic Construct
GSGGGGSCNCKAPETALCARRCQQHG

SEQ ID NO: 800 - DNA, 79 bp, Artificial Sequence; identical to SEQ ID NO: 797
  Oligonucleotide duplex
  misc_feature (1)..(4): Single-stranded DNA in positions 1-4.

SEQ ID NO: 801 - DNA, 39 bp, Artificial Sequence
  Oligonucleotide duplex [4129-18]
tggttccggtggtggtggttccgctttctgcaacctgcg

SEQ ID NO: 802 - DNA, 76 bp, Artificial Sequence
  Oligonucleotide duplex [4129-19]
tatgtgccagctgtcctgccgttccctgggtctgctgggtaaatgcatcggtgacaaatgcgaatgcgttaaacac

SEQ ID NO: 803 - DNA, 40 bp, Artificial Sequence
  Oligonucleotide duplex [4129-20]
cttagtgtttaacgcattcgcatttgtcaccgatgcattt

SEQ ID NO: 804 - DNA, 75 bp, Artificial Sequence
  Oligonucleotide duplex [4129-21]
acccagcagacccagggaacggcaggacagctggcacatacgcaggttgcagaaagcggaaccaccaccaccgga

SEQ ID NO: 805 - DNA, 115 bp, Artificial Sequence
  Oligonucleotide duplex
  misc_feature (1)..(4): Single-stranded DNA in positions 1-4.
  CDS (2)..(115)
tggttccggtggtggtggttccgctttctgcaacctgcgtatgtgccagctgtcctgccgttccctgggtctgctgggtaaatgcatcggtgacaaatgcgaatgcgttaaacac

SEQ ID NO: 806 - protein, 38 aa, Artificial Sequence
  Synthetic Construct
GSGGGGSAFCNLRMCQLSCRSLGLLGKCIGDKCECVKH

SEQ ID NO: 807 - DNA, 115 bp, Artificial Sequence
  Oligonucleotide duplex
  misc_feature (1)..(4): Single-stranded DNA in positions 1-4.
cttagtgtttaacgcattcgcatttgtcaccgatgcatttacccagcagacccagggaacggcaggacagctggcacatacgcaggttgcagaaagcggaaccaccaccaccgga

SEQ ID NO: 808 - DNA, 48 bp, Artificial Sequence
  Oligonucleotide duplex [4194-44]
tggttccggtggtggtggttcccagttcaccgacgttgactgctccgt

SEQ ID NO: 809 - DNA, 85 bp, Artificial Sequence
  Oligonucleotide duplex [4194-45]
ttccaaagaatgctggtccgtttgcaaagacctgttcggtgttgaccgtggtaaatgcatgggtaaaaaatgccgttgctaccag

SEQ ID NO: 810 - DNA, 48 bp, Artificial Sequence
  Oligonucleotide duplex [4194-46]
cttactggtagcaacggcattttttacccatgcatttaccacggtcaa

SEQ ID NO: 811 - DNA, 85 bp, Artificial Sequence
  Oligonucleotide duplex [4194-47]
caccgaacaggtctttgcaaacggaccagcattctttggaaacggagcagtcaacgtcggtgaactgggaaccaccaccaccgga

SEQ ID NO: 812 - DNA, 133 bp, Artificial Sequence
  Oligonucleotide duplex
  misc_feature (1)..(4): Single-stranded DNA in positions 1-4.
  CDS (2)..(133)
tggttccggtggtggtggttcccagttcaccgacgttgactgctccgtttccaaagaatgctggtccgtttgcaaagacctgttcggtgttgaccgtggtaaatgcatgggtaaaaaatgccgttgctaccag

SEQ ID NO: 813 - protein, 44 aa, Artificial Sequence
  Synthetic Construct
GSGGGGSQFTDVDCSVSKECWSVCKDLFGVDRGKCMGKKCRCYQ

SEQ ID NO: 814 - DNA, 133 bp, Artificial Sequence
  Oligonucleotide duplex
  misc_feature (1)..(4): Single-stranded DNA in positions 1-4.
cttactggtagcaacggcattttttacccatgcatttaccacggtcaacaccgaacaggtctttgcaaacggaccagcattctttggaaacggagcagtcaacgtcggtgaactgggaaccaccaccaccgga

SEQ ID NO: 815 - DNA, 48 bp, Artificial Sequence
  Oligonucleotide duplex [4129-06]
tggttccggtggtggtggttccgaatgccgttacctgttcggtggttg

SEQ ID NO: 816 - DNA, 79 bp, Artificial Sequence
  Oligonucleotide duplex [4129-07]
caaaaccacctccgactgctgcaaacacctgggttgcaaattccgtgacaaatactgcgcttgggacttcaccttctcc

SEQ ID NO: 817 - DNA, 48 bp, Artificial Sequence
  Oligonucleotide duplex [4129-08]
cttaggagaaggtgaagtcccaagcgcagtatttgtcacggaatttgc

SEQ ID NO: 818 - DNA, 79 bp, Artificial Sequence
  Oligonucleotide duplex [4129-09]
aacccaggtgtttgcagcagtcggaggtggttttgcaaccaccgaacaggtaacggcattcggaaccaccaccaccgga

SEQ ID NO: 819 - DNA, 127 bp, Artificial Sequence
  Oligonucleotide duplex
  misc_feature (1)..(4): Single-stranded DNA in positions 1-4.
  CDS (2)..(127)
tggttccggtggtggtggttccgaatgccgttacctgttcggtggttgcaaaaccacctccgactgctgcaaacacctgggttgcaaattccgtgacaaatactgcgcttgggacttcaccttctcc

SEQ ID NO: 820 - protein, 42 aa, Artificial Sequence
  Synthetic Construct
GSGGGGSECRYLFGGCKTTSDCCKHLGCKFRDKYCAWDFTFS

SEQ ID NO: 821 - DNA, 127 bp, Artificial Sequence
  Oligonucleotide duplex
  misc_feature (1)..(4): Single-stranded DNA in positions 1-4.
cttaggagaaggtgaagtcccaagcgcagtatttgtcacggaatttgcaacccaggtgtttgcagcagtcggaggtggttttgcaaccaccgaacaggtaacggcattcggaaccaccaccaccgga

SEQ ID NO: 822 - DNA, 38 bp, Artificial Sequence
  Oligonucleotide duplex [4129-14]
tggttccggtggtggtggttcctactgccagaaatgga

SEQ ID NO: 823 - DNA, 77 bp, Artificial Sequence
  Oligonucleotide duplex [4129-15]
tgtggacctgcgacgaagaacgtaaatgctgcgaaggtctggtttgccgtctgtggtgcaaacgtatcatcaacatg

SEQ ID NO: 824 - DNA, 39 bp, Artificial Sequence
  Oligonucleotide duplex [4129-16]
cttacatgttgatgatacgtttgcaccacagacggcaaa

SEQ ID NO: 825 - DNA, 76 bp, Artificial Sequence
  Oligonucleotide duplex [4129-17]
ccagaccttcgcagcatttacgttcttcgtcgcaggtccacatccatttctggcagtaggaaccaccaccaccgga

SEQ ID NO: 826 - DNA, 115 bp, Artificial Sequence
  Oligonucleotide duplex
  misc_feature (1)..(4): Single-stranded DNA in positions 1-4.
  CDS (2)..(115)
tggttccggtggtggtggttcctactgccagaaatggatgtggacctgcgacgaagaacgtaaatgctgcgaaggtctggtttgccgtctgtggtgcaaacgtatcatcaacatg

SEQ ID NO: 827 - protein, 38 aa, Artificial Sequence
  Synthetic Construct
GSGGGGSYCQKWMWTCDEERKCCEGLVCRLWCKRIINM

SEQ ID NO: 828 - DNA, 115 bp, Artificial Sequence
  Oligonucleotide duplex
  misc_feature (1)..(4): Single-stranded DNA in positions 1-4.
cttacatgttgatgatacgtttgcaccacagacggcaaaccagaccttcgcagcatttacgttcttcgtcgcaggtccacatccatttctggcagtaggaaccaccaccaccgga

SEQ ID NO: 829 - DNA, 38 bp, Artificial Sequence
  Oligonucleotide duplex [4128-93]
tggttccggtggtggtggttcctgcaaatccccgggtt

SEQ ID NO: 830 - DNA, 68 bp, Artificial Sequence
  Oligonucleotide duplex [4128-94]
cctcctgctccccgacctcctacaactgctgccgttcctgcaacccgtacaccaaacgttgctacggt

SEQ ID NO: 831 - DNA, 38 bp, Artificial Sequence
  Oligonucleotide duplex [4128-95]
cttaaccgtagcaacgtttggtgtacgggttgcaggaa

SEQ ID NO: 832 - DNA, 68 bp, Artificial Sequence
  Oligonucleotide duplex [4128-96]
cggcagcagttgtaggaggtcggggagcaggaggaacccggggatttgcaggaaccaccaccaccgga

SEQ ID NO: 833 - DNA, 106 bp, Artificial Sequence
  Oligonucleotide duplex
  misc_feature (1)..(4): Single-stranded DNA in positions 1-4.
  CDS (2)..(106)
tggttccggtggtggtggttcctgcaaatccccgggttcctcctgctccccgacctcctacaactgctgccgttcctgcaacccgtacaccaaacgttgctacggt

SEQ ID NO: 834 - protein, 35 aa, Artificial Sequence
  Synthetic Construct
GSGGGGSCKSPGSSCSPTSYNCCRSCNPYTKRCYG

SEQ ID NO: 835 - DNA, 106 bp, Artificial Sequence
  Oligonucleotide duplex
  misc_feature (1)..(4): Single-stranded DNA in positions 1-4.
cttaaccgtagcaacgtttggtgtacgggttgcaggaacggcagcagttgtaggaggtcggggagcaggaggaacccggggatttgcaggaaccaccaccaccgga

SEQ ID NO: 836 - DNA, 34 bp, Artificial Sequence
  Oligonucleotide duplex [4129-02]
tggttccggtggtggtggttcctgcaaaggtaaa

SEQ ID NO: 837 - DNA, 66 bp, Artificial Sequence
  Oligonucleotide duplex [4129-03]
ggtgctaaatgctcccgtctgatgtacgactgctgcaccggttcctgccgttccggtaaatgcggt

SEQ ID NO: 838 - DNA, 34 bp, Artificial Sequence
  Oligonucleotide duplex [4129-04]
cttaaccgcatttaccggaacggcaggaaccggt

SEQ ID NO: 839 - DNA, 66 bp, Artificial Sequence
  Oligonucleotide duplex [4129-05]
gcagcagtcgtacatcagacgggagcatttagcacctttacctttgcaggaaccaccaccaccgga

SEQ ID NO: 840 - DNA, 100 bp, Artificial Sequence
  Oligonucleotide duplex
  misc_feature (1)..(4): Single-stranded DNA in positions 1-4.
  CDS (2)..(100)
tggttccggtggtggtggttcctgcaaaggtaaaggtgctaaatgctcccgtctgatgtacgactgctgcaccggttcctgccgttccggtaaatgcggt

SEQ ID NO: 841 - protein, 33 aa, Artificial Sequence
  Synthetic Construct
GSGGGGSCKGKGAKCSRLMYDCCTGSCRSGKCG

SEQ ID NO: 842 - DNA, 100 bp, Artificial Sequence
  Oligonucleotide duplex
  misc_feature (1)..(4): Single-stranded DNA in positions 1-4.
cttaaccgcatttaccggaacggcaggaaccggtgcagcagtcgtacatcagacgggagcatttagcacctttacctttgcaggaaccaccaccaccgga

SEQ ID NO: 843 - DNA, 40 bp, Artificial Sequence
  Oligonucleotide duplex [4128-97]
tggttccggtggtggtggttccgctgaaaaagactgcatc

SEQ ID NO: 844 - DNA, 84 bp, Artificial Sequence
  Oligonucleotide duplex [4128-98]
gctccgggtgctccgtgcttcggtaccgacaaaccgtgctgcaacccgcgtgcttggtgctcctcctacgctaacaaatgcctg

SEQ ID NO: 845 - DNA, 40 bp, Artificial Sequence
  Oligonucleotide duplex [4128-99]
cttacaggcatttgttagcgtaggaggagcaccaagcacg

SEQ ID NO: 846 - DNA, 84 bp, Artificial Sequence
  Oligonucleotide duplex [4129-01]
cgggttgcagcacggtttgtcggtaccgaagcacggagcacccggagcgatgcagtctttttcagcggaaccaccaccaccgga

SEQ ID NO: 847 - DNA, 124 bp, Artificial Sequence
  Oligonucleotide duplex
  misc_feature (1)..(4): Single-stranded DNA in positions 1-4.
  CDS (2)..(124)
tggttccggtggtggtggttccgctgaaaaagactgcatcgctccgggtgctccgtgcttcggtaccgacaaaccgtgctgcaacccgcgtgcttggtgctcctcctacgctaacaaatgcctg

SEQ ID NO: 848 - protein, 41 aa, Artificial Sequence
  Synthetic Construct
GSGGGGSAEKDCIAPGAPCFGTDKPCCNPRAWCSSYANKCL

SEQ ID NO: 849 - DNA, 124 bp, Artificial Sequence
  Oligonucleotide duplex
  misc_feature (1)..(4): Single-stranded DNA in positions 1-4.
cttacaggcatttgttagcgtaggaggagcaccaagcacgcgggttgcagcacggtttgtcggtaccgaagcacggagcacccggagcgatgcagtctttttcagcggaaccaccaccaccgga

SEQ ID NO: 850 - DNA, 41 bp, Artificial Sequence
  Oligonucleotide duplex [4129-22]
tggttccggtggtggtggttccgaatgccgttactggctgg

SEQ ID NO: 851 - DNA, 86 bp, Artificial Sequence
  Oligonucleotide duplex [4129-23]
gtggttgctccgctggtcagacctgctgcaaacacctggtttgctcccgtcgtcacggttggtgcgtttgggacggtaccttctcc

SEQ ID NO: 852 - DNA, 41 bp, Artificial Sequence
  Oligonucleotide duplex [4129-24]
cttaggagaaggtaccgtcccaaacgcaccaaccgtgacga

SEQ ID NO: 853 - DNA, 86 bp, Artificial Sequence
  Oligonucleotide duplex [4129-25]
cgggagcaaaccaggtgtttgcagcaggtctgaccagcggagcaaccacccagccagtaacggcattcggaaccaccaccaccgga

SEQ ID NO: 854 - DNA, 127 bp, Artificial Sequence
  Oligonucleotide duplex
  misc_feature (1)..(4): Single-stranded DNA in positions 1-4.
  CDS (2)..(127)
tggttccggtggtggtggttccgaatgccgttactggctgggtggttgctccgctggtcagacctgctgcaaacacctggtttgctcccgtcgtcacggttggtgcgtttgggacggtaccttctcc

SEQ ID NO: 855 - protein, 42 aa, Artificial Sequence
  Synthetic Construct
GSGGGGSECRYWLGGCSAGQTCCKHLVCSRRHGWCVWDGTFS

SEQ ID NO: 856 - DNA, 127 bp, Artificial Sequence
  Oligonucleotide duplex
  misc_feature (1)..(4): Single-stranded DNA in positions 1-4
cttaggagaaggtaccgtcccaaacgcaccaaccgtgacgacgggagcaaaccaggtgtttgcagcaggtctgaccagcggagcaaccacccagccagtaacggcattcggaaccaccaccaccgga

SEQ ID NO: 857 - DNA, 42 bp, Artificial Sequence
  Oligonucleotide duplex [4129-10]
tggttccggtggtggtggttcccgtccgaccgacatcaaatg

SEQ ID NO: 858 - DNA, 88 bp, Artificial Sequence
  Oligonucleotide duplex [4129-11]
ctccgaatcctaccagtgcttcccggtttgcaaatcccgtttcggtaaaaccaacggtcgttgcgttaacggtttctgcgactgcttc

SEQ ID NO: 859 - DNA, 42 bp, Artificial Sequence
  Oligonucleotide duplex [4129-12]
cttagaagcagtcgcagaaaccgttaacgcaacgaccgttgg

SEQ ID NO: 860 - DNA, 88 bp, Artificial Sequence
  Oligonucleotide duplex [4129-13]
ttttaccgaaacgggatttgcaaaccgggaagcactggtaggattcggagcatttgatgtcggtcggacgggaaccaccaccaccgga

SEQ ID NO: 861 - DNA, 130 bp, Artificial Sequence
  Oligonucleotide duplex
  misc_feature (1)..(4): Single-stranded DNA in positions 1-4.
  CDS (2)..(130)
tggttccggtggtggtggttcccgtccgaccgacatcaaatgctccgaatcctaccagtgcttcccggtttgcaaatcccgtttcggtaaaaccaacggtcgttgcgttaacggtttctgcgactgcttc

SEQ ID NO: 862 - protein, 43 aa, Artificial Sequence
  Synthetic Construct
GSGGGGSRPTDIKCSESYQCFPVCKSRFGKTNGRCVNGFCDCF

SEQ ID NO: 863 - DNA, 130 bp, Artificial Sequence
  Oligonucleotide duplex
  misc_feature (1)..(4): Single-stranded DNA in positions 1-4.
cttagaagcagtcgcagaaaccgttaacgcaacgaccgttggttttaccgaaacgggatttgcaaaccgggaagcactggtaggattcggagcatttgatgtcggtcggacgggaaccaccaccaccgga

SEQ ID NO: 864 - DNA, 42 bp, Artificial Sequence
  Oligonucleotide duplex [4129-26]
tggttccggtggtggtggttccatgtgcatgccgtgcttcac

SEQ ID NO: 865 - DNA, 88 bp, Artificial Sequence
  Oligonucleotide duplex [4129-27]
caccgaccaccagatggctcgtaaatgcgacgactgctgcggtggtaaaggtcgtggtaaatgctacggtccgcagtgcctgtgccgt

SEQ ID NO: 866 - DNA, 42 bp, Artificial Sequence
  Oligonucleotide duplex [4129-28]
cttaacggcacaggcactgcggaccgtagcatttaccacgac

SEQ ID NO: 867 - DNA, 88 bp, Artificial Sequence
  Oligonucleotide duplex [4129-29]
ctttaccaccgcagcagtcgtcgcatttacgagccatctggtggtcggtggtgaagcacggcatgcacatggaaccaccaccaccgga

SEQ ID NO: 868 - DNA, 130 bp, Artificial Sequence
  Oligonucleotide duplex
  misc_feature (1)..(4): Single-stranded DNA in positions 1-4.
  CDS (2)..(130)
tggttccggtggtggtggttccatgtgcatgccgtgcttcaccaccgaccaccagatggctcgtaaatgcgacgactgctgcggtggtaaaggtcgtggtaaatgctacggtccgcagtgcctgtgccgt

SEQ ID NO: 869 - protein, 43 aa, Artificial Sequence
  Synthetic Construct
GSGGGGSMCMPCFTTDHQMARKCDDCCGGKGRGKCYGPQCLCR

SEQ ID NO: 870 - DNA, 130 bp, Artificial Sequence
  Oligonucleotide duplex
  misc_feature (1)..(4): Single-stranded DNA in positions 1-4.
caccacggcacaggcactgcggaccgtagcatttaccacgacctttaccaccgcagcagtcgtcgcatttacgagccatctggtggtcggtggtgaagcacggcatgcacatggaaccaccaccaccgga

SEQ ID NO: 871 - protein, 32 aa, Artificial Sequence
  CoTx2
VACVYRTCDKDCTSRKYRSGKCINNACKCYPY

SEQ ID NO: 872 - DNA, 92 bp, Artificial Sequence
  BamHI-NotI fragment containing partial linker sequence and SmIIIA peptide.
  misc_feature (1)..(6): BamHI site
  CDS (22)..(81)
  misc_feature (85)..(92): NotI site
ggatccggaggaggaggaagctgctgcaacggccgccgcggctgcagcagccgctggtgccgcgaccacagccgctgctgctgagcggccgc

SEQ ID NO: 873 - protein, 20 aa, Artificial Sequence
  Synthetic Construct
CCNGRRGCSSRWCRDHSRCC

SEQ ID NO: 874 - DNA, 60 bp, Artificial Sequence
  Primer Sequence [3654-50]
ggaggaggatccggaggaggaggaagctgctgcaacggccgccgcggctgcagcagccgc

SEQ ID NO: 875 - DNA, 61 bp, Artificial Sequence
  Primer Sequence [3654-51]
attattgcggccgctcagcagcagcggctgtggtcgcggcaccagcggctgctgcagccgc

SEQ ID NO: 876 - DNA, 88 bp, Artificial Sequence
  OSK1 - Primer Sequence [4210-35]
catggatccggaggaggaggaagcggcgtgatcatcaacgtgaagtgcaagatcagccgccagtgcctggagccctgcaagaaggccg

SEQ ID NO: 877 - DNA, 88 bp, Artificial Sequence
  OSK1 - Primer Sequence [4210-36]
catgcggccgcttactacttgggggtgcagtggcacttgccgttcatgcacttgccgaagcgcatgccggccttcttgcagggctcca

SEQ ID NO: 878 - DNA, 88 bp, Artificial Sequence
  OSK1[K7S] - Primer Sequence [4210-37]
catggatccggaggaggaggaagcggcgtgatcatcaacgtgagctgcaagatcagccgccagtgcctggagccctgcaagaaggccg

SEQ ID NO: 879 - DNA, 88 bp, Artificial Sequence; identical to SEQ ID NO: 877
  OSK1[K7S] - Primer Sequence [4210-36]

SEQ ID NO: 880 - DNA, 88 bp, Artificial Sequence
  OSK1[E16K,K20D] - Primer Sequence [4210-38]
catggatccggaggaggaggaagcggcgtgatcatcaacgtgaagtgcaagatcagccgccagtgcctgaagccctgcaaggacgccg

SEQ ID NO: 881 - DNA, 88 bp, Artificial Sequence
  OSK1[E16K,K20D] - Primer Sequence [4210-39]
catgcggccgcttactacttgggggtgcagtggcacttgccgttcatgcacttgccgaagcgcatgccggcgtccttgcagggcttca

SEQ ID NO: 882 - DNA, 88 bp, Artificial Sequence
  OSK1[K7S,E16K,K20D] - Primer Sequence [4210-40]
catggatccggaggaggaggaagcggcgtgatcatcaacgtgagctgcaagatcagccgccagtgcctgaagccctgcaaggacgccg

SEQ ID NO: 883 - DNA, 88 bp, Artificial Sequence; identical to SEQ ID NO: 881
  OSK1[K7S,E16K,K20D] - Primer Sequence [4210-39]

SEQ ID NO: 884 - protein, 35 aa, Artificial Sequence
  Shk Peptide Sequence - ShK-A9/A22
RSCIDTIPASRCTAFQCKHSMAYRLSFCRKTCGTC

SEQ ID NO: 885 - protein, 34 aa, Artificial Sequence
  Shk Peptide Sequence - ShK-A9/A22 d1
SCIDTIPASRCTAFQCKHSMAYRLSFCRKTCGTC

SEQ ID NO: 886 - protein, 35 aa, Artificial Sequence
  Shk Peptide Sequence - ShK-V9
RSCIDTIPVSRCTAFQCKHSMKYRLSFCRKTCGTC

SEQ ID NO: 887 - protein, 35 aa, Artificial Sequence
  Shk Peptide Sequence - ShK-V9/A22
RSCIDTIPVSRCTAFQCKHSMAYRLSFCRKTCGTC

SEQ ID NO: 888 - protein, 34 aa, Artificial Sequence
  Shk Peptide Sequence - ShK-V9 d1
SCIDTIPVSRCTAFQCKHSMKYRLSFCRKTCGTC

SEQ ID NO: 889 - protein, 34 aa, Artificial Sequence
  Shk Peptide Sequence - ShK-V9/A22 d1
SCIDTIPVSRCTAFQCKHSMAYRLSFCRKTCGTC

SEQ ID NO: 890 - protein, 35 aa, Artificial Sequence
  Shk Peptide Sequence - ShK-E9/A22
RSCIDTIPESRCTAFQCKHSMAYRLSFCRKTCGTC

SEQ ID NO: 891 - protein, 34 aa, Artificial Sequence
  Shk Peptide Sequence - ShK-E9/A22 d1
SCIDTIPESRCTAFQCKHSMAYRLSFCRKTCGTC

SEQ ID NO: 892 - protein, 35 aa, Artificial Sequence
  Shk Peptide Sequence - ShK-A11/A22
RSCIDTIPKSACTAFQCKHSMAYRLSFCRKTCGTC

SEQ ID NO: 893 - protein, 34 aa, Artificial Sequence
  Shk Peptide Sequence - ShK-A11/A22 d1
SCIDTIPKSACTAFQCKHSMAYRLSFCRKTCGTC

SEQ ID NO: 894 - protein, 35 aa, Artificial Sequence
  Shk Peptide Sequence - ShK-E11/A22
RSCIDTIPKSECTAFQCKHSMAYRLSFCRKTCGTC

SEQ ID NO: 895 - protein, 34 aa, Artificial Sequence
  Shk Peptide Sequence - ShK-E11/A22 d1
SCIDTIPKSECTAFQCKHSMAYRLSFCRKTCGTC

SEQ ID NO: 896 - protein, 35 aa, Artificial Sequence
  Shk Peptide Sequence - ShK-D14
RSCIDTIPKSRCTDFQCKHSMKYRLSFCRKTCGTC

SEQ ID NO: 897 - protein, 35 aa, Artificial Sequence
  Shk Peptide Sequence - ShK-D14/A22
RSCIDTIPKSRCTDFQCKHSMAYRLSFCRKTCGTC

SEQ ID NO: 898 - protein, 34 aa, Artificial Sequence
  Shk Peptide Sequence - ShK-D14 d1
SCIDTIPKSRCTDFQCKHSMKYRLSFCRKTCGTC

SEQ ID NO: 899 - protein, 34 aa, Artificial Sequence
  Shk Peptide Sequence - ShK-D14/A22 d1
SCIDTIPKSRCTDFQCKHSMAYRLSFCRKTCGTC

SEQ ID NO: 900 - protein, 35 aa, Artificial Sequence
  Shk Peptide Sequence - ShK-A15/A22
RSCIDTIPKSRCTAAQCKHSMAYRLSFCRKTCGTC

SEQ ID NO: 901 - protein, 34 aa, Artificial Sequence
  Shk Peptide Sequence - ShK-A15/A22 d1
SCIDTIPKSRCTAAQCKHSMAYRLSFCRKTCGTC

SEQ ID NO: 902 - protein, 35 aa, Artificial Sequence
  Shk Peptide Sequence - ShK-I15
RSCIDTIPKSRCTAIQCKHSMKYRLSFCRKTCGTC

SEQ ID NO: 903 - protein, 35 aa, Artificial Sequence
  Shk Peptide Sequence - ShK-I15/A22
RSCIDTIPKSRCTAIQCKHSMAYRLSFCRKTCGTC

SEQ ID NO: 904 - protein, 34 aa, Artificial Sequence
  Shk Peptide Sequence - ShK-I15 d1
SCIDTIPKSRCTAIQCKHSMKYRLSFCRKTCGTC

SEQ ID NO: 905 - protein, 34 aa, Artificial Sequence
  Shk Peptide Sequence - ShK-I15/A22 d1
SCIDTIPKSRCTAIQCKHSMAYRLSFCRKTCGTC

SEQ ID NO: 906 - protein, 35 aa, Artificial Sequence
  Shk Peptide Sequence - ShK-V15
RSCIDTIPKSRCTAVQCKHSMKYRLSFCRKTCGTC

SEQ ID NO: 907 - protein, 35 aa, Artificial Sequence
  Shk Peptide Sequence - ShK-V15/A22
RSCIDTIPKSRCTAVQCKHSMAYRLSFCRKTCGTC

SEQ ID NO: 908 - protein, 34 aa, Artificial Sequence
  Shk Peptide Sequence - ShK-V15 d1
SCIDTIPKSRCTAVQCKHSMKYRLSFCRKTCGTC

SEQ ID NO: 909 - protein, 34 aa, Artificial Sequence
  Shk Peptide Sequence - ShK-V15/A22 d1
SCIDTIPKSRCTAVQCKHSMAYRLSFCRKTCGTC

SEQ ID NO: 910 - protein, 35 aa, Artificial Sequence
  Shk Peptide Sequence - ShK-R16
RSCIDTIPKSRCTAFRCKHSMKYRLSFCRKTCGTC

SEQ ID NO: 911 - protein, 35 aa, Artificial Sequence
  Shk Peptide Sequence - ShK-R16/A22
RSCIDTIPKSRCTAFRCKHSMAYRLSFCRKTCGTC

SEQ ID NO: 912 - protein, 34 aa, Artificial Sequence
  Shk Peptide Sequence - ShK-R16 d1
SCIDTIPKSRCTAFRCKHSMKYRLSFCRKTCGTC

SEQ ID NO: 913 - protein, 34 aa, Artificial Sequence
  Shk Peptide Sequence - ShK-R16/A22 d1
SCIDTIPKSRCTAFRCKHSMAYRLSFCRKTCGTC

SEQ ID NO: 914 - protein, 35 aa, Artificial Sequence
  Shk Peptide Sequence - ShK-K16
RSCIDTIPKSRCTAFKCKHSMKYRLSFCRKTCGTC

SEQ ID NO: 915 - protein, 35 aa, Artificial Sequence
  Shk Peptide Sequence - ShK-K16/A22
RSCIDTIPKSRCTAFKCKHSMAYRLSFCRKTCGTC

SEQ ID NO: 916 - protein, 34 aa, Artificial Sequence
  Shk Peptide Sequence - ShK-K16 d1
SCIDTIPKSRCTAFKCKHSMKYRLSFCRKTCGTC

SEQ ID NO: 917 - protein, 34 aa, Artificial Sequence
  Shk Peptide Sequence - ShK-K16/A22 d1
SCIDTIPKSRCTAFKCKHSMAYRLSFCRKTCGTC

SEQ ID NO: 918 - protein, 35 aa, Artificial Sequence
  Shk Peptide Sequence - ShK-A9/E11
RSCIDTIPASECTAFQCKHSMKYRLSFCRKTCGTC

SEQ ID NO: 919 - protein, 35 aa, Artificial Sequence
  Shk Peptide Sequence - ShK-A9/E11/A22
RSCIDTIPASECTAFQCKHSMAYRLSFCRKTCGTC

SEQ ID NO: 920 - protein, 34 aa, Artificial Sequence
  Shk Peptide Sequence - ShK-A9/E11 d1
SCIDTIPASECTAFQCKHSMKYRLSFCRKTCGTC

SEQ ID NO: 921 - protein, 34 aa, Artificial Sequence
  Shk Peptide Sequence - ShK-A9/E11/A22 d1
SCIDTIPASECTAFQCKHSMAYRLSFCRKTCGTC

SEQ ID NO: 922 - protein, 35 aa, Artificial Sequence
  Shk Peptide Sequence - ShK-V9/E11
RSCIDTIPVSECTAFQCKHSMKYRLSFCRKTCGTC

SEQ ID NO: 923 - protein, 35 aa, Artificial Sequence
  Shk Peptide Sequence - ShK-V9/E11/A22
RSCIDTIPVSECTAFQCKHSMAYRLSFCRKTCGTC

SEQ ID NO: 924 - protein, 34 aa, Artificial Sequence
  Shk Peptide Sequence - ShK-V9/E11 d1
SCIDTIPVSECTAFQCKHSMKYRLSFCRKTCGTC

SEQ ID NO: 925 - protein, 34 aa, Artificial Sequence
  Shk Peptide Sequence - ShK-V9/E11/A22 d1
SCIDTIPVSECTAFQCKHSMAYRLSFCRKTCGTC

SEQ ID NO: 926 - protein, 35 aa, Artificial Sequence
  Shk Peptide Sequence - ShK-V9/A11
RSCIDTIPVSACTAFQCKHSMKYRLSFCRKTCGTC

SEQ ID NO: 927 - protein, 35 aa, Artificial Sequence
  Shk Peptide Sequence - ShK-V9/A11/A22
RSCIDTIPVSACTAFQCKHSMAYRLSFCRKTCGTC

SEQ ID NO: 928 - protein, 34 aa, Artificial Sequence
  Shk Peptide Sequence - ShK-V9/A11 d1
SCIDTIPVSACTAFQCKHSMKYRLSFCRKTCGTC

SEQ ID NO: 929 - protein, 34 aa, Artificial Sequence
  Shk Peptide Sequence - ShK-V9/A11/A22 d1
SCIDTIPVSACTAFQCKHSMAYRLSFCRKTCGTC

SEQ ID NO: 930 - protein, 35 aa, Artificial Sequence
  Shk Peptide Sequence - ShK-A9/A11
RSCIDTIPASACTAFQCKHSMKYRLSFCRKTCGTC

SEQ ID NO: 931 - protein, 35 aa, Artificial Sequence
  Shk Peptide Sequence - ShK-A9/A11/A22
RSCIDTIPASACTAFQCKHSMAYRLSFCRKTCGTC

SEQ ID NO: 932 - protein, 34 aa, Artificial Sequence
  Shk Peptide Sequence - ShK-A9/A11 d1
SCIDTIPASACTAFQCKHSMKYRLSFCRKTCGTC

SEQ ID NO: 933 - protein, 34 aa, Artificial Sequence
  Shk Peptide Sequence - ShK-A9/A11/A22 d1
SCIDTIPASACTAFQCKHSMAYRLSFCRKTCGTC

SEQ ID NO: 934 - protein, 35 aa, Artificial Sequence
  Shk Peptide Sequence - ShK-E11/D14/I15/R16
RSCIDTIPKSECTDIRCKHSMKYRLSFCRKTCGTC

SEQ ID NO: 935 - protein, 35 aa, Artificial Sequence
  Shk Peptide Sequence - ShK-E11/D14/I15/R16/A22
RSCIDTIPKSECTDIRCKHSMAYRLSFCRKTCGTC

SEQ ID NO: 936 - protein, 34 aa, Artificial Sequence
  Shk Peptide Sequence - ShK-E11/D14/I15/R16 d1
SCIDTIPKSECTDIRCKHSMKYRLSFCRKTCGTC

SEQ ID NO: 937 - protein, 34 aa, Artificial Sequence
  Shk Peptide Sequence - ShK-E11/D14/I15/R16/A22 d1
SCIDTIPKSECTDIRCKHSMAYRLSFCRKTCGTC

SEQ ID NO: 938 - protein, 35 aa, Artificial Sequence
  Shk Peptide Sequence - ShK-V9/E11/D14/I15/R16
RSCIDTIPVSECTDIRCKHSMKYRLSFCRKTCGTC

SEQ ID NO: 939 - protein, 35 aa, Artificial Sequence
  Shk Peptide Sequence - ShK-V9/E11/D14/I15/R16/A22
RSCIDTIPVSECTDIRCKHSMAYRLSFCRKTCGTC

SEQ ID NO: 940 - protein, 34 aa, Artificial Sequence
  Shk Peptide Sequence - ShK-V9/E11/D14/I15/R16 d1
SCIDTIPVSECTDIRCKHSMKYRLSFCRKTCGTC

SEQ ID NO: 941 - protein, 34 aa, Artificial Sequence
  Shk Peptide Sequence - ShK-V9/E11/D14/I15/R16/A22 d1
SCIDTIPVSECTDIRCKHSMAYRLSFCRKTCGTC

SEQ ID NO: 942 - protein, 35 aa, Artificial Sequence
  Shk Peptide Sequence - ShK-V9/E11/D14/I15
RSCIDTIPVSECTDIQCKHSMKYRLSFCRKTCGTC

SEQ ID NO: 943 - protein, 35 aa, Artificial Sequence
  Shk Peptide Sequence - ShK-V9/E11/D14/I15/A22
RSCIDTIPVSECTDIQCKHSMAYRLSFCRKTCGTC

SEQ ID NO: 944 - protein, 34 aa, Artificial Sequence
  Shk Peptide Sequence - ShK-V9/E11/D14/I15 d1
SCIDTIPVSECTDIQCKHSMKYRLSFCRKTCGTC

SEQ ID NO: 945 - protein, 34 aa, Artificial Sequence
  Shk Peptide Sequence - ShK-V9/E11/D14/I15/A22 d1
SCIDTIPVSECTDIQCKHSMAYRLSFCRKTCGTC

SEQ ID NO: 946 - protein, 35 aa, Artificial Sequence
  Shk Peptide Sequence - ShK-T2/K4/L6/V9/E11/D14/I15/R16
RTCKDLIPVSECTDIRCKHSMKYRLSFCRKTCGTC

SEQ ID NO: 947 - protein, 35 aa, Artificial Sequence
  Shk Peptide Sequence - ShK-T2/K4/L6/V9/E11/D14/I15/R16/A22
RTCKDLIPVSECTDIRCKHSMAYRLSFCRKTCGTC

SEQ ID NO: 948 - protein, 34 aa, Artificial Sequence
  Shk Peptide Sequence - ShK-T2/K4/L6/V9/E11/D14/I15/R16 d1
TCKDLIPVSECTDIRCKHSMKYRLSFCRKTCGTC

SEQ ID NO: 949 - protein, 34 aa, Artificial Sequence
  Shk Peptide Sequence - ShK-T2/K4/L6/V9/E11/D14/I15/R16/A22 d1
TCKDLIPVSECTDIRCKHSMAYRLSFCRKTCGTC

SEQ ID NO: 950 - protein, 40 aa, Artificial Sequence
  Shk (L5)
  MISC_FEATURE (1)..(1): X in position 1 is phosphotyrosine.
XAEEARSCIDTIPKSRCTAFQCKHSMKYRLSFCRKTCGTC

SEQ ID NO: 951 - DNA, 888 bp, Artificial Sequence
  Fc-L10-OSK1
  CDS (1)..(888)
atggaatggagctgggtctttctcttcttcctgtcagtaacgactggtgtccactccgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggaggaggaggatccggaggaggaggaagcggcgtgatcatcaacgtgaagtgcaagatcagccgccagtgcctggagccctgcaagaaggccggcatgcgcttcggcaagtgcatgaacggcaagtgccactgcacccccaagtagtaa

SEQ ID NO: 952 - protein, 294 aa, Artificial Sequence
  Synthetic Construct
MEWSWVFLFFLSVTTGVHSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGVIINVKCKISRQCLEPCKKAGMRFGKCMNGKCHCTPK

SEQ ID NO: 953 - DNA, 888 bp, Artificial Sequence
  Fc-L10-OSK1 [K7S]
  CDS (1)..(888)
atggaatggagctgggtctttctcttcttcctgtcagtaacgactggtgtccactccgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggaggaggaggatccggaggaggaggaagcggcgtgatcatcaacgtgagctgcaagatcagccgccagtgcctggagccctgcaagaaggccggcatgcgcttcggcaagtgcatgaacggcaagtgccactgcacccccaagtagtaa

SEQ ID NO: 954 - protein, 294 aa, Artificial Sequence [sequence omitted]

SEQ ID NO: 955 - DNA, 888 bp, Artificial Sequence
  Fc-L10-OSK1 [E16K, K20D]
  CDS (1)..(888)
atggaatggagctgggtctttctcttcttcctgtcagtaacgactggtgtccactccgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggaggaggaggatccggaggaggaggaagcggcgtgatcatcaacgtgaagtgcaagatcagccgccagtgcctgaagccctgcaaggacgccggcatgcgcttcggcaagtgcatgaacggcaagtgccactgcacccccaagtagtaa

SEQ ID NO: 956 - protein, 294 aa, Artificial Sequence
  Synthetic Construct
MEWSWVFLFFLSVTTGVHSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGVIINVKCKISRQCLKPCKDAGMRFGKCMNGKCHCTPK

SEQ ID NO: 957 - DNA, 888 bp, Artificial Sequence
  Fc-L10-OSK1 [K7S, E16K, K20D]
  CDS (1)..(888)
atggaatggagctgggtctttctcttcttcctgtcagtaacgactggtgtccactccgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggaggaggaggatccggaggaggaggaagcggcgtgatcatcaacgtgagctgcaagatcagccgccagtgcctgaagccctgcaaggacgccggcatgcgcttcggcaagtgcatgaacggcaagtgccactgcacccccaagtagtaa

SEQ ID NO: 958 - protein, 294 aa, Artificial Sequence
  Synthetic Construct
MEWSWVFLFFLSVTTGVHSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGVIINVSCKISRQCLKPCKDAGMRFGKCMNGKCHCTPK

SEQ ID NO: 959 - protein, 48 aa, Artificial Sequence
  Agelenopsis aperta (Agatoxin) toxin peptide sequence - Omega-Aga-IVA
KKKCIAKDYGRCKWGGTPCCRGRGCICSIMGTNCECKPRLIMEGLGLA

SEQ ID NO: 960 - protein, 48 aa, Artificial Sequence
  Agelenopsis aperta (Agatoxin) toxin peptide sequence - Omega-Aga-IVB
EDNCIAEDYGKCTWGGTKCCRGRPCRCSMIGTNCECTPRLIMEGLSFA

SEQ ID NO: 961 - protein, 76 aa, Artificial Sequence
  Agelenopsis aperta (Agatoxin) toxin peptide sequence - Omega-Aga-IIIA
SCIDIGGDCDGEKDDCQCCRRNGYCSCYSLFGYLKSGCKCVVGTSAEFQGICRRKARQCYNSDPDKCESHNKPKRR

SEQ ID NO: 962 - protein, 76 aa, Artificial Sequence
  Agelenopsis aperta (Agatoxin) toxin peptide sequence - Omega-Aga-IIIA-T58
SCIDIGGDCDGEKDDCQCCRRNGYCSCYSLFGYLKSGCKCVVGTSAEFQGICRRKARTCYNSDPDKCESHNKPKRR

SEQ ID NO: 963 - protein, 76 aa, Artificial Sequence
  Agelenopsis aperta (Agatoxin) toxin peptide sequence - Omega-Aga-IIIB
SCIDFGGDCDGEKDDCQCCRSNGYCSCYSLFGYLKSGCKCEVGTSAEFRRICRRKAKQCYNSDPDKCVSVYKPKRR

SEQ ID NO: 964 - protein, 76 aa, Artificial Sequence
  Agelenopsis aperta (Agatoxin) toxin peptide sequence - Omega-Aga-IIIB-N29
SCIDFGGDCDGEKDDCQCCRSNGYCSCYNLFGYLKSGCKCEVGTSAEFRRICRRKAKQCYNSDPDKCVSVYKPKRR

SEQ ID NO: 965 - protein, 76 aa, Artificial Sequence
  Agelenopsis aperta (Agatoxin) toxin peptide sequence - Omega-Aga-IIIB-N29/R35
SCIDFGGDCDGEKDDCQCCRSNGYCSCYNLFGYLRSGCKCEVGTSAEFRRICRRKAKQCYNSDPDKCVSVYKPKRR

SEQ ID NO: 966 - protein, 43 aa, Artificial Sequence
  Agelenopsis aperta (Agatoxin) toxin peptide sequence - Omega-Aga-IIIC
  misc_feature (20)..(20): Xaa can be any naturally occurring amino acid
  misc_feature (40)..(40): Xaa can be any naturally occurring amino acid
NCIDFGGDCDGEKDDCQCCXRNGYCSCYNLFGYLKRGCKXEVG

SEQ ID NO: 967 - protein, 37 aa, Artificial Sequence
  Agelenopsis aperta (Agatoxin) toxin peptide sequence - Omega-Aga-IIID
  misc_feature (27)..(27): Xaa can be any naturally occurring amino acid
  misc_feature (29)..(29): Xaa can be any naturally occurring amino acid
SCIKIGEDCDGDKDDCQCCRTNGYCSXYXLFGYLKSG

SEQ ID NO: 968 - protein, 28 aa, Artificial Sequence
  Agelenopsis aperta (Agatoxin) toxin peptide sequence - Omega-Aga-IIA
GCIEIGGDCDGYQEKSYCQCCRNNGFCS

SEQ ID NO: 969 - protein, 66 aa, Artificial Sequence
  Agelenopsis aperta (Agatoxin) toxin peptide sequence - Omega-Aga-IA (major chain)
AKALPPGSVCDGNESDCKCYGKWHKCRCPWKWHFTGEGPCTCEKGMKHTCITKLHCPNKAEWGLDW

SEQ ID NO: 970 - protein, 37 aa, Artificial Sequence
  Agelenopsis aperta (Agatoxin) toxin peptide sequence - mu-Aga
  misc_feature (37)..(37): Xaa can be any naturally occurring amino acid
ECVPENGHCRDWYDECCEGFYCSCRQPPKCICRNNNX

SEQ ID NO: 971 - protein, 37 aa, Artificial Sequence
  Agelenopsis aperta (Agatoxin) toxin peptide sequence - mu-Aga-6
DCVGESQQCADWAGPHCCDGYYCTCRYFPKCICVNNN

SEQ ID NO: 972 - protein, 37 aa, Artificial Sequence
  Agelenopsis aperta (Agatoxin) toxin peptide sequence - mu-Aga-5
ACVGENKQCADWAGPHCCDGYYCTCRYFPKCICRNNN

SEQ ID NO: 973 - protein, 37 aa, Artificial Sequence
  Agelenopsis aperta (Agatoxin) toxin peptide sequence - mu-Aga-4
ACVGENQQCADWAGPHCCDGYYCTCRYFPKCICRNNN

SEQ ID NO: 974 - protein, 37 aa, Artificial Sequence
  Agelenopsis aperta (Agatoxin) toxin peptide sequence - mu-Aga-2
ECATKNKRCADWAGPWCCDGLYCSCRSYPGCMCRPSS

SEQ ID NO: 975 - protein, 36 aa, Artificial Sequence
  Agelenopsis aperta (Agatoxin) toxin peptide sequence - mu-Aga-1
ECVPENGHCRDWYDECCEGFYCSCRQPPKCICRNNN

SEQ ID NO: 976 - protein, 270 aa, Artificial Sequence
  FcLoop-L2-OsK1-L2
  MISC_FEATURE (1)..(139): Fc(N-term)
  MISC_FEATURE (142)..(179): OsK1
  MISC_FEATURE (182)..(270): Fc(C-term)
MDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELGGGVIINVKCKISRQCLEPCKKAGMRFGKCMNGKCHCTPKGGTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 977 - protein, 267 aa, Artificial Sequence
  FcLoop-L2-ShK-L2
  MISC_FEATURE (1)..(139): Fc(N-term)
  MISC_FEATURE (142)..(176): ShK
  MISC_FEATURE (179)..(267): Fc(C-term)
MDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELGGRSCIDTIPKSRCTAFQCKHSMKYRLSFCRKTCGTCGGTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 978 - protein, 269 aa, Artificial Sequence
  FcLoop-L2-ShK-L4
  MISC_FEATURE (1)..(139): Fc(N-term)
  MISC_FEATURE (142)..(176): ShK
  MISC_FEATURE (181)..(269): Fc(C-term)
MDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELGGRSCIDTIPKSRCTAFQCKHSMKYRLSFCRKTCGTCGGGGTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 979 - protein, 272 aa, Artificial Sequence
  FcLoop-L4-OsK1-L2
  MISC_FEATURE (1)..(139): Fc(N-term)
  MISC_FEATURE (144)..(181): OsK1
  MISC_FEATURE (184)..(272): Fc(C-term)
MDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELGGGGGVIINVKCKISRQCLEPCKKAGMRFGKCMNGKCHCTPKGGTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 980 - protein, 38 aa, Artificial Sequence
  OSK1-O16,D20
  MOD_RES (16)..(16): Ornithine
  misc_feature (16)..(16): Xaa can be any naturally occurring amino acid
GVIINVKCKISRQCLXPCKDAGMRFGKCMNGKCHCTPK

SEQ ID NO: 981 - protein, 38 aa, Artificial Sequence; identical to SEQ ID NO: 980
  OSK1-hLys 16,D20
  MISC_FEATURE (16)..(16): Homolysine

SEQ ID NO: 982 - protein, 38 aa, Artificial Sequence; identical to SEQ ID NO: 980
  OSK1-hArg 16,D20
  MISC_FEATURE (16)..(16): Homoarginine

SEQ ID NO: 983 - protein, 38 aa, Artificial Sequence; identical to SEQ ID NO: 980
  OSK1-Cit 16,D20
  MISC_FEATURE (16)..(16): Citrulline

SEQ ID NO: 984 - protein, 38 aa, Artificial Sequence; identical to SEQ ID NO: 980
  OSK1-hCit 16,D20
  MISC_FEATURE (16)..(16): Homocitrulline

SEQ ID NO: 985 - protein, 38 aa, Artificial Sequence; identical to SEQ ID NO: 980
  OSK1-Dpr 16,D20
  MISC_FEATURE (16)..(16): Alpha,beta-diaminopropionoic acid

SEQ ID NO: 986 - protein, 38 aa, Artificial Sequence; identical to SEQ ID NO: 980
  OSK1-Dab 16,D20
  MISC_FEATURE (16)..(16): Alpha,gamma-diaminobutyric acid

SEQ ID NO: 987 - protein, 38 aa, Artificial Sequence
  OSK1-O16,D20,Y36
  MOD_RES (16)..(16): Ornithine
  misc_feature (16)..(16): Xaa can be any naturally occurring amino acid
GVIINVKCKISRQCLXPCKDAGMRFGKCMNGKCHCYPK

SEQ ID NO: 988 - protein, 38 aa, Artificial Sequence; identical to SEQ ID NO: 987
  OSK1-hLys 16,D20,Y36
  MISC_FEATURE (16)..(16): Homolysine

SEQ ID NO: 989 - protein, 38 aa, Artificial Sequence; identical to SEQ ID NO: 987
  OSK1-hArg 16,D20,Y36
  MISC_FEATURE (16)..(16): Homoarginine

SEQ ID NO: 990 - protein, 38 aa, Artificial Sequence; identical to SEQ ID NO: 987
  OSK1-Cit 16,D20,Y36
  MISC_FEATURE (16)..(16): Citrulline

SEQ ID NO: 991 - protein, 38 aa, Artificial Sequence; identical to SEQ ID NO: 987
  OSK1-hCit 16,D20,Y36
  MISC_FEATURE (16)..(16): Homocitrulline

SEQ ID NO: 992 - protein, 38 aa, Artificial Sequence; identical to SEQ ID NO: 987
  OSK1-Dpr 16,D20,Y36
  MISC_FEATURE (16)..(16): Alpha,beta-diaminopropionoic acid

SEQ ID NO: 993 - protein, 38 aa, Artificial Sequence; identical to SEQ ID NO: 987
  OSK1-Dab 16,D20,Y36
  MISC_FEATURE (16)..(16): Alpha,gamma-diaminobutyric acid

SEQ ID NO: 994 - protein, 38 aa, Artificial Sequence
  OSK1-K16,D20,A34,Y36
GVIINVKCKISRQCLKPCKDAGMRFGKCMNGKCACYPK

SEQ ID NO: 995 - protein, 38 aa, Artificial Sequence
  OSK1-K16,D20,G34,Y36
GVIINVKCKISRQCLKPCKDAGMRFGKCMNGKCGCYPK

SEQ ID NO: 996 - protein, 38 aa, Artificial Sequence
  OSK1-K16,D20,A34,F36
GVIINVKCKISRQCLKPCKDAGMRFGKCMNGKCACFPK

SEQ ID NO: 997 - protein, 38 aa, Artificial Sequence
  OSK1-K16,D20,A34,W36
GVIINVKCKISRQCLKPCKDAGMRFGKCMNGKCACWPK

SEQ ID NO: 998 - protein, 38 aa, Artificial Sequence
  OSK1-K16,E20,A34,Y36
GVIINVKCKISRQCLKPCKEAGMRFGKCMNGKCACYPK

SEQ ID NO: 999 - protein, 38 aa, Artificial Sequence
  OSK1-O16,D20,A34
  MISC_FEATURE (16)..(16): Ornithine
GVIINVKCKISRQCLXPCKDAGMRFGKCMNGKCACTPK

SEQ ID NO: 1000 - protein, 38 aa, Artificial Sequence; identical to SEQ ID NO: 999
  OSK1-hLys 16,D20,A34
  MISC_FEATURE (16)..(16): Homolysine

SEQ ID NO: 1001 - protein, 38 aa, Artificial Sequence; identical to SEQ ID NO: 999
  OSK1-hArg 16,D20,A34
  MISC_FEATURE (16)..(16): Homoarginine

SEQ ID NO: 1002 - protein, 38 aa, Artificial Sequence; identical to SEQ ID NO: 999
  OSK1-Cit 16,D20,A34
  MISC_FEATURE (16)..(16): Citrulline

SEQ ID NO: 1003 - protein, 38 aa, Artificial Sequence; identical to SEQ ID NO: 980
  OSK1-hCit 16,D20,A34
  MISC_FEATURE (16)..(16): Homocitrulline

SEQ ID NO: 1004 - protein, 40 aa, Artificial Sequence
  OSK1-Dpr 16,D20,A34
  MISC_FEATURE (16)..(16): Alpha,beta-diaminopropionoic acid
GVIINVKCKISRQCLXPRPCKDAGMRFGKCMNGKCACTPK

SEQ ID NO: 1005 - protein, 38 aa, Artificial Sequence; identical to SEQ ID NO: 999
  OSK1-Dab 16,D20,A34
  MISC_FEATURE (16)..(16): Alpha,gamma-diaminobutyric acid

SEQ ID NO: 1006 - protein, 35 aa, Artificial Sequence
  Delta36-38, OSK1-O16,D20
  MISC_FEATURE (16)..(16): Ornithine
GVIINVKCKISRQCLXPCKDAGMRFGKCMNGKCHC

SEQ ID NO: 1007 - protein, 35 aa, Artificial Sequence; identical to SEQ ID NO: 1006
  Delta36-38, OSK1-hLys 16,D20
  MISC_FEATURE (16)..(16): Homolysine

SEQ ID NO: 1008 - protein, 35 aa, Artificial Sequence; identical to SEQ ID NO: 1006
  Delta36-38, OSK1-hArg 16,D20
  MISC_FEATURE (16)..(16): Homoarginine

SEQ ID NO: 1009 - protein, 35 aa, Artificial Sequence; identical to SEQ ID NO: 1006
  Delta36-38, OSK1-Cit 16,D20
  MISC_FEATURE (16)..(16): Citrulline

SEQ ID NO: 1010 - protein, 35 aa, Artificial Sequence; identical to SEQ ID NO: 1006
  Delta36-38, OSK1-hCit 16,D20
  MISC_FEATURE (16)..(16): Homocitrulline

SEQ ID NO: 1011 - protein, 35 aa, Artificial Sequence; identical to SEQ ID NO: 1006
  Delta36-38, OSK1-Dpr 16,D20
  MISC_FEATURE (16)..(16): Alpha,beta-diaminopropionoic acid

SEQ ID NO: 1012 - protein, 35 aa, Artificial Sequence; identical to SEQ ID NO: 1006
  Delta36-38, OSK1-Dab 16,D20
  MISC_FEATURE (16)..(16): Alpha,gamma-diaminobutyric acid

SEQ ID NO: 1013 - protein, 35 aa, Artificial Sequence
  Delta36-38, OSK1-O16,D20,A34
  MISC_FEATURE (16)..(16): Ornithine
GVIINVKCKISRQCLXPCKDAGMRFGKCMNGKCAC

SEQ ID NO: 1014 - protein, 35 aa, Artificial Sequence; identical to SEQ ID NO: 1013
  Delta36-38, OSK1-hLys 16,D20,A34
  MISC_FEATURE (16)..(16): Homolysine

SEQ ID NO: 1015 - protein, 35 aa, Artificial Sequence; identical to SEQ ID NO: 1013
  Delta36-38, OSK1-hArg 16,D20,A34
  MISC_FEATURE (16)..(16): Homoarginine

SEQ ID NO: 1016 - protein, 35 aa, Artificial Sequence; identical to SEQ ID NO: 1013
  Delta36-38, OSK1-Cit 16,D20,A34
  MISC_FEATURE (16)..(16): Citrulline

SEQ ID NO: 1017 - protein, 35 aa, Artificial Sequence; identical to SEQ ID NO: 1006
  Delta36-38, OSK1-hCit 16,D20,A34
  MISC_FEATURE (16)..(16): Homocitrulline

SEQ ID NO: 1018 - protein, 35 aa, Artificial Sequence; identical to SEQ ID NO: 1013
  Delta36-38, OSK1-Dpr 16,D20,A34
  MISC_FEATURE (16)..(16): Alpha,beta-diaminopropionoic acid

SEQ ID NO: 1019 - protein, 35 aa, Artificial Sequence; identical to SEQ ID NO: 1013
  Delta36-38, OSK1-Dab 16,D20,A34
  MISC_FEATURE (16)..(16): Alpha,gamma-diaminobutyric acid

SEQ ID NO: 1020 - protein, 38 aa, Artificial Sequence
  OSK1-K16,D20,G34,Y36,G37,G38
GVIINVKCKISRQCLKPCKDAGMRFGKCMNGKCGCYGG

SEQ ID NO: 1021 - protein, 38 aa, Artificial Sequence
  OSK1-O16,D20,Y36,G37,G38
  MISC_FEATURE (16)..(16): Ornithine
GVIINVKCKISRQCLXPCKDAGMRFGKCMNGKCHCYGG

SEQ ID NO: 1022 - protein, 38 aa, Artificial Sequence; identical to SEQ ID NO: 1021
  OSK1-hLys 16,D20,Y36,G37,G38
  MISC_FEATURE (16)..(16): Homolysine

SEQ ID NO: 1023 - protein, 38 aa, Artificial Sequence; identical to SEQ ID NO: 1021
  OSK1-hArg 16,D20,Y36,G37,G38
  MISC_FEATURE (16)..(16): Homoarginine

SEQ ID NO: 1024 - protein, 38 aa, Artificial Sequence; identical to SEQ ID NO: 1021
  OSK1-Cit 16,D20,Y36,G37,G38
  MISC_FEATURE (16)..(16): Citrulline

SEQ ID NO: 1025 - protein, 38 aa, Artificial Sequence; identical to SEQ ID NO: 1021
  OSK1-hCit 16,D20,Y36,G37,G38
  MISC_FEATURE (16)..(16): Homocitrulline

SEQ ID NO: 1026 - protein, 38 aa, Artificial Sequence; identical to SEQ ID NO: 1021
  OSK1-Dpr 16,D20,Y36,G37,G38
  MISC_FEATURE (16)..(16): Alpha,beta-diaminopropionoic acid

SEQ ID NO: 1027 - protein, 38 aa, Artificial Sequence
  OSK1-K16,D20,A34,Y36,G37,G38
GVIINVKCKISRQCLKPCKDAGMRFGKCMNGKCACYGG

SEQ ID NO: 1028 - protein, 38 aa, Artificial Sequence
  OSK1-O16,D20,A34,Y36,G37,G38
  MISC_FEATURE (16)..(16): Ornithine
GVIINVKCKISRQCLXPCKDAGMRFGKCMNGKCACYGG

SEQ ID NO: 1029 - protein, 38 aa, Artificial Sequence; identical to SEQ ID NO: 1028
  OSK1-hLys 16,D20,A34,Y36,G37,G38
  MISC_FEATURE (16)..(16): Homolysine

SEQ ID NO: 1030 - protein, 38 aa, Artificial Sequence; identical to SEQ ID NO: 1028
  OSK1-hArg 16,D20,A34,Y36,G37,G38
  MISC_FEATURE (16)..(16): Homoarginine

SEQ ID NO: 1031 - protein, 38 aa, Artificial Sequence; identical to SEQ ID NO: 1028
  OSK1-Cit 16,D20,A34,Y36,G37,G38
  MISC_FEATURE (16)..(16): Citrulline

SEQ ID NO: 1032 - protein, 38 aa, Artificial Sequence; identical to SEQ ID NO: 1021
  OSK1-hCit 16,D20,A34,Y3,G37,G38
  MISC_FEATURE (16)..(16): Homocitrulline

SEQ ID NO: 1033 - protein, 38 aa, Artificial Sequence; identical to SEQ ID NO: 1028
  OSK1-Dpr 16,D20,A34,Y36,G37,G38
  MISC_FEATURE (16)..(16): Alpha,beta-diaminopropionoic acid

SEQ ID NO: 1034 - protein, 38 aa, Artificial Sequence; identical to SEQ ID NO: 1028
  OSK1-Dab 16,D20,A34,Y36,G37,G38
  MISC_FEATURE (16)..(16): Alpha,gamma-diaminobutyric acid

SEQ ID NO: 1035 - protein, 37 aa, Artificial Sequence
  Delta38, OSK1-K16,D20,A34,Y36,G37
GVIINVKCKISRQCLKPCKDAGMRFGKCMNGKCACYG

SEQ ID NO: 1036 - protein, 38 aa, Artificial Sequence
  OSK1-O16,D20,G36-38
  MISC_FEATURE (16)..(16): Ornithine
GVIINVKCKISRQCLXPCKDAGMRFGKCMNGKCHCGGG

SEQ ID NO: 1037 - protein, 38 aa, Artificial Sequence; identical to SEQ ID NO: 1036
  OSK1-hLys 16,D20,G36-38
  MISC_FEATURE (16)..(16): Homolysine

SEQ ID NO: 1038 - protein, 38 aa, Artificial Sequence; identical to SEQ ID NO: 1036
  OSK1-hArg 16,D20,G36-38
  MISC_FEATURE (16)..(16): Homoarginine

SEQ ID NO: 1039 - protein, 38 aa, Artificial Sequence; identical to SEQ ID NO: 1036
  OSK1-Cit 16,D20,G36-38
  MISC_FEATURE (16)..(16): Citrulline

SEQ ID NO: 1040 - protein, 38 aa, Artificial Sequence; identical to SEQ ID NO: 1036
  OSK1-hCit 16,D20,G36-38
  MISC_FEATURE (16)..(16): Homocitrulline

SEQ ID NO: 1041 - protein, 38 aa, Artificial Sequence; identical to SEQ ID NO: 1036
  OSK1-Dpr 16,D20,G36-38
  MISC_FEATURE (16)..(16): Alpha,beta-diaminopropionoic acid

SEQ ID NO: 1042 - protein, 38 aa, Artificial Sequence
  OSK1-K16,D20,A34,F36,G37,G38
GVIINVKCKISRQCLKPCKDAGMRFGKCMNGKCACFGG

SEQ ID NO: 1043 - protein, 38 aa, Artificial Sequence
  OSK1-O16,D20,A34,G36-38
  MISC_FEATURE (16)..(16): Ornithine
GVIINVKCKISRQCLXPCKDAGMRFGKCMNGKCACGGG

SEQ ID NO: 1044 - protein, 38 aa, Artificial Sequence; identical to SEQ ID NO: 1043
  OSK1-hLys 16,D20,A34,G36-38
  MISC_FEATURE (16)..(16): Homolysine

SEQ ID NO: 1045 - protein, 38 aa, Artificial Sequence; identical to SEQ ID NO: 1043
  OSK1-hArg 16,D20,A34,G36-38
  MISC_FEATURE (16)..(16): Homoarginine

SEQ ID NO: 1046 - protein, 38 aa, Artificial Sequence; identical to SEQ ID NO: 1043
  OSK1-Cit 16,D20,A34,G36-38
  MISC_FEATURE (16)..(16): Citrulline

SEQ ID NO: 1047 - protein, 38 aa, Artificial Sequence; identical to SEQ ID NO: 1043
  OSK1-hCit 16,D20,A34,G36-38
  MISC_FEATURE (16)..(16): Homocitrulline

SEQ ID NO: 1048 - protein, 38 aa, Artificial Sequence; identical to SEQ ID NO: 1043
  OSK1-Dpr 16,D20,A34,G36-38
  MISC_FEATURE (16)..(16): Alpha,beta-diaminopropionoic acid

SEQ ID NO: 1049 - protein, 38 aa, Artificial Sequence; identical to SEQ ID NO: 1043
  OSK1-Dab 16,D20,A34,G36-38
  MISC_FEATURE (16)..(16): Alpha,gamma-diaminobutyric acid

SEQ ID NO: 1050 - protein, 37 aa, Artificial Sequence
  Delta38, OSK1-K16,D20,A34,G36-37
GVIINVKCKISRQCLKPCKDAGMRFGKCMNGKCACGG

SEQ ID NO: 1051 - protein, 37 aa, Artificial Sequence; identical to SEQ ID NO: 1035
  Delta38, OSK1-K16,D20,A35,Y36,G37

SEQ ID NO: 1052 - protein, 37 aa, Artificial Sequence
  Delta38, OSK1-O16,D20,A35,Y36,G37
  MISC_FEATURE (16)..(16): Ornithine
GVIINVKCKISRQCLXPCKDAGMRFGKCMNGKCACGG

SEQ ID NO: 1053 - protein, 38 aa, Artificial Sequence
  OSK1-hLys 16,E20
  MISC_FEATURE (16)..(16): Homolysine
GVIINVKCKISRQCLXPCKEAGMRFGKCMNGKCHCTPK

SEQ ID NO: 1054 - protein, 38 aa, Artificial Sequence; identical to SEQ ID NO: 1053
  OSK1-hArg 16,E20
  MISC_FEATURE (16)..(16): Homoarginine

SEQ ID NO: 1055 - protein, 38 aa, Artificial Sequence; identical to SEQ ID NO: 1053
  OSK1-Cit 16,E20
  MISC_FEATURE (16)..(16): Citrulline

SEQ ID NO: 1056 - protein, 38 aa, Artificial Sequence; identical to SEQ ID NO: 1053
  OSK1-hCit 16,E20
  MISC_FEATURE (16)..(16): Homocitrulline

SEQ ID NO: 1057 - protein, 38 aa, Artificial Sequence; identical to SEQ ID NO: 1053
  OSK1-Dpr 16,E20
  MISC_FEATURE (16)..(16): Alpha,beta-diaminopropionoic acid

SEQ ID NO: 1058 - protein, 38 aa, Artificial Sequence; identical to SEQ ID NO: 1053
  OSK1-Dab 16,E20
  MISC_FEATURE (16)..(16): Alpha,gamma-diaminobutyric acid

SEQ ID NO: 1059 - protein, 38 aa, Artificial Sequence
  OSK1-O16,E20,Y36
  MISC_FEATURE (16)..(16): Ornithine
GVIINVKCKISRQCLXPCKEAGMRFGKCMNGKCHCYPK

SEQ ID NO: 1060 - protein, 38 aa, Artificial Sequence; identical to SEQ ID NO: 1059
  OSK1-hLys 16,E20,Y36
  MISC_FEATURE (16)..(16): Homolysine

SEQ ID NO: 1061 - protein, 38 aa, Artificial Sequence; identical to SEQ ID NO: 1059
  OSK1-hArg 16,E20,Y36
  MISC_FEATURE (16)..(16): Homoarginine

SEQ ID NO: 1062 - protein, 38 aa, Artificial Sequence; identical to SEQ ID NO: 1059
  OSK1-Cit 16,E20,Y36
  MISC_FEATURE (16)..(16): Citrulline

SEQ ID NO: 1063 - protein, 38 aa, Artificial Sequence; identical to SEQ ID NO: 1059
  OSK1-hCit 16,E20,Y36
  MISC_FEATURE (16)..(16): Homocitrulline

SEQ ID NO: 1064 - protein, 38 aa, Artificial Sequence; identical to SEQ ID NO: 1059
  OSK1-Dpr 16,E20,Y36
  MISC_FEATURE (16)..(16): Alpha,beta-diaminopropionoic acid

SEQ ID NO: 1065 - protein, 38 aa, Artificial Sequence; identical to SEQ ID NO: 1059
  OSK1-Dab 16,E20,Y36
  MISC_FEATURE (16)..(16): Alpha,gamma-diaminobutyric acid

SEQ ID NO: 1066 - protein, 38 aa, Artificial Sequence
  OSK1-O16,E20,A34
  MISC_FEATURE (16)..(16): Ornithine
GVIINVKCKISRQCLXPCKEAGMRFGKCMNGKCACTPK

SEQ ID NO: 1067 - protein, 38 aa, Artificial Sequence; identical to SEQ ID NO: 1066
  OSK1-hLys 16,E20,A34
  MISC_FEATURE (16)..(16): Homolysine

SEQ ID NO: 1068 - protein, 38 aa, Artificial Sequence; identical to SEQ ID NO: 1066
  OSK1-hArg 16,E20,A34
  MISC_FEATURE (16)..(16): Homoarginine

SEQ ID NO: 1069 - protein, 38 aa, Artificial Sequence; identical to SEQ ID NO: 1066
  OSK1-Cit 16,E20,A34
  MISC_FEATURE (16)..(16): Citrulline

SEQ ID NO: 1070 - protein, 38 aa, Artificial Sequence; identical to SEQ ID NO: 1053
  OSK1-hCit 16,E20,A34
  MISC_FEATURE (16)..(16): Homocitrulline

SEQ ID NO: 1071 - protein, 38 aa, Artificial Sequence; identical to SEQ ID NO: 1066
  OSK1-Dpr 16,E20,A34
  MISC_FEATURE (16)..(16): Alpha,beta-diaminopropionoic acid

SEQ ID NO: 1072 - protein, 38 aa, Artificial Sequence; identical to SEQ ID NO: 1066
  OSK1-Dab 16,E20,A34
  MISC_FEATURE (16)..(16): Alpha,gamma-diaminobutyric acid

SEQ ID NO: 1073 - protein, 35 aa, Artificial Sequence
  Delta36-38, OSK1-O16,E20,
  MISC_FEATURE (16)..(16): Ornithine
GVIINVKCKISRQCLXPCKEAGMRFGKCMNGKCHC

SEQ ID NO: 1074 - protein, 35 aa, Artificial Sequence; identical to SEQ ID NO: 1073
  Delta36-38, OSK1-hLys 16,E20
  MISC_FEATURE (16)..(16): Homolysine

SEQ ID NO: 1075 - protein, 35 aa, Artificial Sequence; identical to SEQ ID NO: 1073
  Delta36-38, OSK1-hArg 16,E20
  MISC_FEATURE (16)..(16): Homoarginine

SEQ ID NO: 1076 - protein, 35 aa, Artificial Sequence; identical to SEQ ID NO: 1073
  Delta36-38, OSK1-Cit 16,E20
  MISC_FEATURE (16)..(16): Citrulline

SEQ ID NO: 1077 - protein, 35 aa, Artificial Sequence; identical to SEQ ID NO: 1073
  Delta36-38, OSK1-hCit16,E20
  MISC_FEATURE (16)..(16): Homocitrulline

SEQ ID NO: 1078 - protein, 35 aa, Artificial Sequence; identical to SEQ ID NO: 1073
  Delta36-38, OSK1-Dpr 16,E20
  MISC_FEATURE (16)..(16): Alpha,beta-diaminopropionoic acid

SEQ ID NO: 1079 - protein, 35 aa, Artificial Sequence
  Delta36-38, OSK1-O16,E20,A34
  MISC_FEATURE (16)..(16): Ornithine
GVIINVKCKISRQCLXPCKEAGMRFGKCMNGKCAC

SEQ ID NO: 1080 - protein, 35 aa, Artificial Sequence; identical to SEQ ID NO: 1079
  Delta36-38, OSK1-hLys 16,E20,A34
  MISC_FEATURE (16)..(16): Homolysine

SEQ ID NO: 1081 - protein, 35 aa, Artificial Sequence; identical to SEQ ID NO: 1079
  Delta36-38, OSK1-hArg 16,E20,A34
  MISC_FEATURE (16)..(16): Homoarginine

SEQ ID NO: 1082 - protein, 35 aa, Artificial Sequence; identical to SEQ ID NO: 1079
  Delta36-38, OSK1-Cit 16,E20,A34
  MISC_FEATURE (16)..(16): Citrulline

SEQ ID NO: 1083 - protein, 35 aa, Artificial Sequence; identical to SEQ ID NO: 1073
  Delta36-38, OSK1-hCit 16,E20,A34
  MISC_FEATURE (16)..(16): Homocitrulline

SEQ ID NO: 1084 - protein, 35 aa, Artificial Sequence; identical to SEQ ID NO: 1079
  Delta36-38, OSK1-Dpr 16,E20,A34
  MISC_FEATURE (16)..(16): Alpha,beta-diaminopropionoic acid

SEQ ID NO: 1085 - protein, 35 aa, Artificial Sequence; identical to SEQ ID NO: 1079
  Delta36-38, OSK1-Dab 16,E20,A34
  MISC_FEATURE (16)..(16): Alpha,gamma-diaminobutyric acid

SEQ ID NO: 1086 - protein, 38 aa, Artificial Sequence
  OSK1-K16,E20,Y36,G37,G38
GVIINVKCKISRQCLKPCKEAGMRFGKCMNGKCHCYGG

SEQ ID NO: 1087 - protein, 38 aa, Artificial Sequence
  OSK1-O16,E20,Y36,G37,G38
  MISC_FEATURE (16)..(16): Ornithine
GVIINVKCKISRQCLXPCKEAGMRFGKCMNGKCHCYGG

SEQ ID NO: 1088 - protein, 37 aa, Artificial Sequence
  Delta38 OSK1-K16,E20,Y36,G37
GVIINVKCKISRQCLKPCKEAGMRFGKCMNGKCHCYG

SEQ ID NO: 1089 - protein, 37 aa, Artificial Sequence
  Delta38 OSK1-K16,E20,A34, Y36,G37
GVIINVKCKISRQCLKPCKEAGMRFGKCMNGKCACYG

SEQ ID NO: 1090 - protein, 38 aa, Artificial Sequence; identical to SEQ ID NO: 1087
  OSK1-hLys 16,E20,Y36,G37,G38
  MISC_FEATURE (16)..(16): Homolysine

SEQ ID NO: 1091 - protein, 38 aa, Artificial Sequence; identical to SEQ ID NO: 1087
  OSK1-hArg 16,E20,Y36,G37,G38
  MISC_FEATURE (16)..(16): Homoarginine

SEQ ID NO: 1092 - protein, 38 aa, Artificial Sequence; identical to SEQ ID NO: 1087
  OSK1-Cit 16,E20,Y36,G37,G38
  MISC_FEATURE (16)..(16): Citrulline

SEQ ID NO: 1093 - protein, 38 aa, Artificial Sequence; identical to SEQ ID NO: 1087
  Delta37-38, OSK1-hCit 16,E20,Y36,G37,G38
  MISC_FEATURE (16)..(16): Homocitrulline

SEQ ID NO: 1094 - protein, 38 aa, Artificial Sequence; identical to SEQ ID NO: 1087
  OSK1-Dpr 16,E20,Y36,G37,G38
  MISC_FEATURE (16)..(16): Alpha,beta-diaminopropionoic acid

SEQ ID NO: 1095 - protein, 38 aa, Artificial Sequence; identical to SEQ ID NO: 1087
  OSK1-Dab 16,E20,Y36,G37,G38
  MISC_FEATURE (16)..(16): Alpha,gamma-diaminobutyric acid

SEQ ID NO: 1096 - protein, 37 aa, Artificial Sequence; identical to SEQ ID NO: 1089
  Delta38, OSK1-K16,E20,A34,Y36,G37

SEQ ID NO: 1097 - protein, 38 aa, Artificial Sequence
  OSK1-O16,E20,A34,Y36,G37,G38
  MISC_FEATURE (16)..(16): Ornithine
GVIINVKCKISRQCLXPCKEAGMRFGKCMNGKCACYGG

SEQ ID NO: 1098 - protein, 38 aa, Artificial Sequence; identical to SEQ ID NO: 1097
  OSK1-hLys 16,E20,A34,Y36,G37,G38
  MISC_FEATURE (16)..(16): Homolysine

SEQ ID NO: 1099 - protein, 38 aa, Artificial Sequence; identical to SEQ ID NO: 1097
  OSK1-hArg 16,E20,A34,Y36,G37,G38
  MISC_FEATURE (16)..(16): Homoarginine

SEQ ID NO: 1100 - protein, 38 aa, Artificial Sequence; identical to SEQ ID NO: 1097
  OSK1-Cit 16,E20,A34,Y36,G37,G38
  MISC_FEATURE (16)..(16): Citrulline

SEQ ID NO: 1101 - protein, 38 aa, Artificial Sequence; identical to SEQ ID NO: 1087
  OSK1-hCit 16,E20,A34,Y3,G37,G38
  MISC_FEATURE (16)..(16): Homocitrulline

SEQ ID NO: 1102 - protein, 38 aa, Artificial Sequence; identical to SEQ ID NO: 1097
  OSK1-Dpr 16,E20,A34,Y36,G37,G38
  MISC_FEATURE (16)..(16): Alpha,beta-diaminopropionoic acid

SEQ ID NO: 1103 - protein, 38 aa, Artificial Sequence; identical to SEQ ID NO: 1097
  OSK1-Dab 16,E20,A34,Y36,G37,G38
  MISC_FEATURE (16)..(16): Alpha,gamma-diaminobutyric acid

SEQ ID NO: 1104 - protein, 38 aa, Artificial Sequence
  OSK1-K16,D20,A34,F36,G37,G38
GVIINVKCKISRQCLKPCKEAGMRFGKCMNGKCACFGG

SEQ ID NO: 1105 - protein, 38 aa, Artificial Sequence
  OSK1-O16,E20,G36-38
  MISC_FEATURE (16)..(16): Ornithine
GVIINVKCKISRQCLXPCKEAGMRFGKCMNGKCHCGGG

SEQ ID NO: 1106 - protein, 38 aa, Artificial Sequence; identical to SEQ ID NO: 1105
  OSK1-hLys 16,E20,G36-38
  MISC_FEATURE (16)..(16): Homolysine

SEQ ID NO: 1107 - protein, 38 aa, Artificial Sequence; identical to SEQ ID NO: 1105
  OSK1-hArg 16,E20,G36-38
  MISC_FEATURE (16)..(16): Homoarginine

SEQ ID NO: 1108 - protein, 38 aa, Artificial Sequence; identical to SEQ ID NO: 1105
  OSK1-Cit 16,E20,G36-38
  MISC_FEATURE (16)..(16): Citrulline

SEQ ID NO: 1109 - protein, 38 aa, Artificial Sequence; identical to SEQ ID NO: 1105
  OSK1-hCit 16,E20,G36-38
  MISC_FEATURE (16)..(16): Homocitrulline

SEQ ID NO: 1110 - protein, 38 aa, Artificial Sequence; identical to SEQ ID NO: 1105
  OSK1-Dpr 16,E20,G36-38
  MISC_FEATURE (16)..(16): Alpha,beta-diaminopropionoic acid

SEQ ID NO: 1111 - protein, 38 aa, Artificial Sequence
  OSK1-O16,E20,A34,G36-38
  MISC_FEATURE (16)..(16): Ornithine
GVIINVKCKISRQCLXPCKEAGMRFGKCMNGKCACGGG

SEQ ID NO: 1112 - protein, 38 aa, Artificial Sequence; identical to SEQ ID NO: 1111
  OSK1-hLys 16,E20,A34,G36-38
  MISC_FEATURE (16)..(16): Homolysine

SEQ ID NO: 1113 - protein, 38 aa, Artificial Sequence; identical to SEQ ID NO: 1111
  OSK1-hArg 16,E20,A34,G36-38
  MISC_FEATURE (16)..(16): Homoarginine

SEQ ID NO: 1114 - protein, 38 aa, Artificial Sequence; identical to SEQ ID NO: 1111
  OSK1-Cit 16,E20,A34,G36-38
  MISC_FEATURE (16)..(16): Citrulline

SEQ ID NO: 1115 - protein, 37 aa, Artificial Sequence
  OSK1-hCit 16,E20,A34,G36-38
  MISC_FEATURE (16)..(16): Homocitrulline
GVIINVKCKISRQCLXPCKEAGMRFGKCMNGKCACTP

SEQ ID NO: 1116 - protein, 37 aa, Artificial Sequence; identical to SEQ ID NO: 1115
  OSK1-Dpr 16,E20,A34,G36-38
  MISC_FEATURE (16)..(16): Alpha,beta-diaminopropionoic acid

SEQ ID NO: 1117 - protein, 37 aa, Artificial Sequence; identical to SEQ ID NO: 1115
  OSK1-Dab 16,E20,A34,G36-38
  MISC_FEATURE (16)..(16): Alpha,gamma-diaminobutyric acid

SEQ ID NO: 1118 - protein, 38 aa, Artificial Sequence; identical to SEQ ID NO: 980
  OSK1-O16,D20-amide
  MISC_FEATURE (16)..(16): Ornithine
  MOD_RES (38)..(38): AMIDATION

SEQ ID NO: 1119 - protein, 38 aa, Artificial Sequence; identical to SEQ ID NO: 980
  OSK1-hLys 16,D20-amide
  MISC_FEATURE (16)..(16): Homolysine
  MOD_RES (38)..(38): AMIDATION

SEQ ID NO: 1120 - protein, 38 aa, Artificial Sequence; identical to SEQ ID NO: 980
  OSK1-hArg 16,D20-amide
  MISC_FEATURE (16)..(16): Homoarginine
  MOD_RES (38)..(38): AMIDATION

SEQ ID NO: 1121 - protein, 38 aa, Artificial Sequence; identical to SEQ ID NO: 980
  OSK1-Cit 16,D20-amide
  MISC_FEATURE (16)..(16): Citrulline
  MOD_RES (38)..(38): AMIDATION

SEQ ID NO: 1122 - protein, 38 aa, Artificial Sequence; identical to SEQ ID NO: 980
  OSK1-hCit 16,D20-amide
  MISC_FEATURE (16)..(16): Homocitrulline
  MOD_RES (38)..(38): AMIDATION

SEQ ID NO: 1123 - protein, 38 aa, Artificial Sequence; identical to SEQ ID NO: 980
  OSK1-Dpr 16,D20-amide
  MISC_FEATURE (16)..(16): Alpha,beta-diaminopropionoic acid
  MOD_RES (38)..(38): AMIDATION

SEQ ID NO: 1124 - protein, 38 aa, Artificial Sequence; identical to SEQ ID NO: 980
  OSK1-Dab 16,D20-amide
  MISC_FEATURE (16)..(16): Alpha,gamma-diaminobutyric acid
  MOD_RES (38)..(38): AMIDATION

SEQ ID NO: 1125 - protein, 38 aa, Artificial Sequence; identical to SEQ ID NO: 987
  OSK1-O16,D20,Y36-amide
  MISC_FEATURE (16)..(16): Ornithine
  MOD_RES (38)..(38): AMIDATION

SEQ ID NO: 1126 - protein, 38 aa, Artificial Sequence; identical to SEQ ID NO: 987
  OSK1-hLys 16,D20,Y36-amide
  MISC_FEATURE (16)..(16): Homolysine
  MOD_RES (38)..(38): AMIDATION

SEQ ID NO: 1127 - protein, 38 aa, Artificial Sequence; identical to SEQ ID NO: 987
  OSK1-hArg 16,D20,Y36-amide
  MISC_FEATURE (16)..(16): Homoarginine
  MOD_RES (38)..(38): AMIDATION

SEQ ID NO: 1128 - protein, 38 aa, Artificial Sequence; identical to SEQ ID NO: 987
  OSK1-Cit 16,D20,Y36-amide
  MISC_FEATURE (16)..(16): Citrulline
  MOD_RES (38)..(38): AMIDATION

SEQ ID NO: 1129 - protein, 38 aa, Artificial Sequence; identical to SEQ ID NO: 987
  OSK1-hCit 16,D20,Y36-amide
  MISC_FEATURE (16)..(16): Homocitrulline
  MOD_RES (38)..(38): AMIDATION

SEQ ID NO: 1130 - protein, 38 aa, Artificial Sequence; identical to SEQ ID NO: 987
  OSK1-Dpr 16,D20,Y36-amide
  MISC_FEATURE (16)..(16): Alpha,beta-diaminopropionoic acid
  MOD_RES (38)..(38): AMIDATION

SEQ ID NO: 1131 - protein, 38 aa, Artificial Sequence; identical to SEQ ID NO: 987
  OSK1-Dab 16,D20,Y36-amide
  MISC_FEATURE (16)..(16): Alpha,gamma-diaminobutyric acid
  MOD_RES (38)..(38): AMIDATION

SEQ ID NO: 1132 - protein, 38 aa, Artificial Sequence; identical to SEQ ID NO: 999
  OSK1-O16,D20,A34-amide
  MISC_FEATURE (16)..(16): Ornithine
  MOD_RES (38)..(38): AMIDATION

SEQ ID NO: 1133 - protein, 38 aa, Artificial Sequence; identical to SEQ ID NO: 999
  OSK1-hLys 16,D20,A34-amide
  MISC_FEATURE (16)..(16): Homolysine
  MOD_RES (38)..(38): AMIDATION

SEQ ID NO: 1134 - protein, 38 aa, Artificial Sequence; identical to SEQ ID NO: 999
  OSK1-hArg 16,D20,A34-amide
  MISC_FEATURE (16)..(16): Homoarginine
  MOD_RES (38)..(38): AMIDATION

SEQ ID NO: 1135 - protein, 38 aa, Artificial Sequence; identical to SEQ ID NO: 999
  OSK1-Cit 16,D20,A34-amide
  MISC_FEATURE (16)..(16): Citrulline
  MOD_RES (38)..(38): AMIDATION

SEQ ID NO: 1136 - protein, 38 aa, Artificial Sequence; identical to SEQ ID NO: 999
  OSK1-hCit 16,D20,A34-amide
  MISC_FEATURE (16)..(16): Homocitrulline
  MOD_RES (38)..(38): AMIDATION

SEQ ID NO: 1137 - protein, 38 aa, Artificial Sequence; identical to SEQ ID NO: 999
  OSK1-Dpr 16,D20,A34-amide
  MISC_FEATURE (16)..(16): Alpha,beta-diaminopropionoic acid
  MOD_RES (38)..(38): AMIDATION

SEQ ID NO: 1138 - protein, 38 aa, Artificial Sequence; identical to SEQ ID NO: 999
  OSK1-Dab 16,D20,A34-amide
  MISC_FEATURE (16)..(16): Alpha,gamma-diaminobutyric acid
  MOD_RES (38)..(38): AMIDATION

SEQ ID NO: 1139 - protein, 35 aa, Artificial Sequence; identical to SEQ ID NO: 1006
  Delta36-38, OSK1-O16,D20-amide
  MISC_FEATURE (16)..(16): Ornithine
  MOD_RES (35)..(35): AMIDATION

SEQ ID NO: 1140 - protein, 35 aa, Artificial Sequence; identical to SEQ ID NO: 1006
  Delta36-38, OSK1-hLys 16,D20-amide
  MISC_FEATURE (16)..(16): Homolysine
  MOD_RES (35)..(35): AMIDATION

SEQ ID NO: 1141 - protein, 35 aa, Artificial Sequence; identical to SEQ ID NO: 1006
  Delta36-38, OSK1-hArg 16,D20-amide
  MISC_FEATURE (16)..(16): Homoarginine
  MOD_RES (35)..(35): AMIDATION

SEQ ID NO: 1142 - protein, 35 aa, Artificial Sequence; identical to SEQ ID NO: 1006
  Delta36-38, OSK1-Cit 16,D20-amide
  MISC_FEATURE (16)..(16): Citrulline
  MOD_RES (35)..(35): AMIDATION

SEQ ID NO: 1143 - protein, 35 aa, Artificial Sequence; identical to SEQ ID NO: 1006
  Delta36-38, OSK1- hCit16,D20-amide
  MISC_FEATURE (16)..(16): Homocitrulline
  MOD_RES (35)..(35): AMIDATION

SEQ ID NO: 1144 - protein, 35 aa, Artificial Sequence; identical to SEQ ID NO: 1006
  Delta36-38, OSK1-Dpr 16,D20-amide
  MISC_FEATURE (16)..(16): Alpha,beta-diaminopropionoic acid
  MOD_RES (35)..(35): AMIDATION

SEQ ID NO: 1145 - protein, 35 aa, Artificial Sequence; identical to SEQ ID NO: 1013
  Delta36-38, OSK1-O16,D20,A34-amide
  MISC_FEATURE (16)..(16): Ornithine
  MOD_RES (35)..(35): AMIDATION

SEQ ID NO: 1146 - protein, 35 aa, Artificial Sequence; identical to SEQ ID NO: 1013
  Delta36-38, OSK1-hLys 16,D20,A34-amide
  MISC_FEATURE (16)..(16): Homolysine
  MOD_RES (35)..(35): AMIDATION

SEQ ID NO: 1147 - protein, 35 aa, Artificial Sequence; identical to SEQ ID NO: 1013
  Delta36-38, OSK1-hArg 16,D20,A34-amide
  MISC_FEATURE (16)..(16): Homoaginine
  MOD_RES (35)..(35): AMIDATION

SEQ ID NO: 1148 - protein, 35 aa, Artificial Sequence; identical to SEQ ID NO: 1013
  Delta36-38, OSK1-Cit 16,D20,A34-amide
  MISC_FEATURE (16)..(16): Citrulline
  MOD_RES (35)..(35): AMIDATION

SEQ ID NO: 1149 - protein, 35 aa, Artificial Sequence; identical to SEQ ID NO: 1006
  Delta36-38, OSK1- hCit16,D20,A34-amide
  MISC_FEATURE (16)..(16): Homocitrulline
  MOD_RES (35)..(35): AMIDATION

SEQ ID NO: 1150 - protein, 35 aa, Artificial Sequence; identical to SEQ ID NO: 1013
  Delta36-38, OSK1-Dpr 16,D20,A34-amide
  MISC_FEATURE (16)..(16): Alpha,beta-diaminopropionoic acid
  MOD_RES (35)..(35): AMIDATION

SEQ ID NO: 1151 - protein, 35 aa, Artificial Sequence; identical to SEQ ID NO: 1013
  Delta36-38, OSK1-Dab 16,D20,A34-amide
  MISC_FEATURE (16)..(16): Alpha,gamma-diaminobutyric acid
  MOD_RES (35)..(35): AMIDATION

SEQ ID NO: 1152 - protein, 38 aa, Artificial Sequence
  OSK1-O16,D20,Y36,G37,G38-amide
  MOD_RES (38)..(38): AMIDATION
GVIINVKCKISRQCLKPCKDAGMRFGKCMNGKCHCYGG

SEQ ID NO: 1153 - protein, 38 aa, Artificial Sequence; identical to SEQ ID NO: 1021
  OSK1-O16,D20,Y36,G37,G38
  MISC_FEATURE (16)..(16): Ornithine
  MOD_RES (38)..(38): AMIDATION

SEQ ID NO: 1154 - protein, 38 aa, Artificial Sequence; identical to SEQ ID NO: 1021
  OSK1-hLys 16,D20,Y36,G37,G38-amide
  MISC_FEATURE (16)..(16): Homolysine
  MOD_RES (38)..(38): AMIDATION

SEQ ID NO: 1155 - protein, 38 aa, Artificial Sequence; identical to SEQ ID NO: 1021
  OSK1-hArg 16,D20,Y36,G37,G38-amide
  MISC_FEATURE (16)..(16): Homoarginine
  MOD_RES (38)..(38): AMIDATION

SEQ ID NO: 1156 - protein, 38 aa, Artificial Sequence; identical to SEQ ID NO: 1021
  OSK1-Cit -amide 16,D20,Y36,G37,G38-amide
  MISC_FEATURE (16)..(16): Citrulline
  MOD_RES (38)..(38): AMIDATION

SEQ ID NO: 1157 - protein, 38 aa, Artificial Sequence; identical to SEQ ID NO: 1021
  OSK1- hCit16,D20,Y36,G37,G38-amide
  MISC_FEATURE (16)..(16): Homocitrulline
  MOD_RES (38)..(38): AMIDATION

SEQ ID NO: 1158 - protein, 38 aa, Artificial Sequence; identical to SEQ ID NO: 1021
  OSK1-Dpr 16,D20,Y36,G37,G38-amide
  MISC_FEATURE (16)..(16): Alpha,beta-diaminopropionoic acid
  MOD_RES (38)..(38): AMIDATION

SEQ ID NO: 1159 - protein, 38 aa, Artificial Sequence
  OSK1-K16,D20,F36,G37,G38-amide
  MOD_RES (38)..(38): AMIDATION
GVIINVKCKISRQCLKPCKDAGMRFGKCMNGKCHCFGG

SEQ ID NO: 1160 - protein, 37 aa, Artificial Sequence
  Delta38-OSK1-K16,D20,Y36,G37-amide
  MOD_RES (37)..(37): AMIDATION
GVIINVKCKISRQCLKPCKDAGMRFGKCMNGKCHCYG

SEQ ID NO: 1161 - protein, 37 aa, Artificial Sequence; identical to SEQ ID NO: 1035
  Delta38-OSK1-K16,D20,A34, Y36,G37-amide
  MOD_RES (37)..(37): AMIDATION

SEQ ID NO: 1162 - protein, 38 aa, Artificial Sequence; identical to SEQ ID NO: 1028
  OSK1-O16,D20,A34,Y36,G37,G38-amide
  MISC_FEATURE (16)..(16): Ornithine
  MOD_RES (38)..(38): AMIDATION

SEQ ID NO: 1163 - protein, 38 aa, Artificial Sequence; identical to SEQ ID NO: 1028
  OSK1-hLys 16,D20,A34,Y36,G37,G38-amide
  MISC_FEATURE (16)..(16): Homolysine
  MOD_RES (38)..(38): AMIDATION

SEQ ID NO: 1164 - protein, 38 aa, Artificial Sequence; identical to SEQ ID NO: 1028
  OSK1-hArg 16,D20,A34,Y36,G37,G38-amide
  MISC_FEATURE (16)..(16): Homoarginine
  MOD_RES (38)..(38): AMIDATION

SEQ ID NO: 1165 - protein, 38 aa, Artificial Sequence; identical to SEQ ID NO: 1028
  OSK1-Cit 16,D20,A34,Y36,G37,G38
  MISC_FEATURE (16)..(16): Citrulline
  MOD_RES (38)..(38): AMIDATION

SEQ ID NO: 1166 - protein, 38 aa, Artificial Sequence; identical to SEQ ID NO: 1028
  OSK1- hCit16,D20,A34,Y3,G37,G38-amide
  MISC_FEATURE (16)..(16): Homocitrulline
  MOD_RES (38)..(38): AMIDATION

SEQ ID NO: 1167 - protein, 38 aa, Artificial Sequence; identical to SEQ ID NO: 1028
  OSK1-Dpr 16,D20,A34,Y36,G37,G38-amide
  MISC_FEATURE (16)..(16): Alpha,beta-diaminopropionoic acid
  MOD_RES (38)..(38): AMIDATION

SEQ ID NO: 1168 - protein, 38 aa, Artificial Sequence; identical to SEQ ID NO: 1028
  OSK1-Dab 16,D20,A34,Y36,G37,G38-amide
  MISC_FEATURE (16)..(16): Alpha,gamma-diaminobutyric acid
  MOD_RES (38)..(38): AMIDATION

SEQ ID NO: 1169 - protein, 38 aa, Artificial Sequence; identical to SEQ ID NO: 1027
  OSK1-K16,D20,A34,Y36,G37,G38-amide
  MOD_RES (38)..(38): AMIDATION

SEQ ID NO: 1170 - protein, 38 aa, Artificial Sequence; identical to SEQ ID NO: 1036
  OSK1-O16,D20,G36-38-amide
  MISC_FEATURE (16)..(16): Ornithine
  MOD_RES (38)..(38): AMIDATION

SEQ ID NO: 1171 - protein, 38 aa, Artificial Sequence; identical to SEQ ID NO: 1036
  OSK1-hLys 16,D20,G36-38-amide
  MISC_FEATURE (16)..(16): Homolysine
  MOD_RES (38)..(38): AMIDATION

SEQ ID NO: 1172 - protein, 38 aa, Artificial Sequence; identical to SEQ ID NO: 1036
  OSK1-hArg 16,D20,G36-38-amide
  MISC_FEATURE (16)..(16): Homoarginine
  MOD_RES (38)..(38): AMIDATION

SEQ ID NO: 1173 - protein, 38 aa, Artificial Sequence; identical to SEQ ID NO: 1036
  OSK1-Cit 16,D20,G36-38-amide
  MISC_FEATURE (16)..(16): Citrulline
  MOD_RES (38)..(38): AMIDATION

SEQ ID NO: 1174 - protein, 38 aa, Artificial Sequence; identical to SEQ ID NO: 1036
  OSK1- hCit16,D20,G36-38-amide
  MISC_FEATURE (16)..(16): Homocitrulline
  MOD_RES (38)..(38): AMIDATION

SEQ ID NO: 1175 - protein, 38 aa, Artificial Sequence; identical to SEQ ID NO: 1036
  OSK1-Dpr 16,D20,G36-38-amide
  MISC_FEATURE (16)..(16): Alpha,beta-diaminopropionoic acid
  MOD_RES (38)..(38): AMIDATION

SEQ ID NO: 1176 - protein, 38 aa, Artificial Sequence
  OSK1-K16,D20,A34,G36-38-amide
  MOD_RES (38)..(38): AMIDATION
GVIINVKCKISRQCLKPCKDAGMRFGKCMNGKCACGGG

SEQ ID NO: 1177 - protein, 38 aa, Artificial Sequence
  OSK1-O16,D20,A34,F36, G37-38-amide
  MISC_FEATURE (16)..(16): Ornithine
  MOD_RES (38)..(38): AMIDATION
GVIINVKCKISRQCLXPCKDAGMRFGKCMNGKCACFGG

SEQ ID NO: 1178 - protein, 38 aa, Artificial Sequence; identical to SEQ ID NO: 1043
  OSK1-O16,D20,A34,G36-38-amide
  MISC_FEATURE (16)..(16): Ornithine
  MOD_RES (38)..(38): AMIDATION

SEQ ID NO: 1179 - protein, 38 aa, Artificial Sequence; identical to SEQ ID NO: 1043
  OSK1-hLys 16,D20,A34,G36-38-amide
  MISC_FEATURE (16)..(16): Homolysine
  MOD_RES (38)..(38): AMIDATION

SEQ ID NO: 1180 - protein, 38 aa, Artificial Sequence; identical to SEQ ID NO: 1043
  OSK1-hArg 16,D20,A34,G36-38-amide
  MISC_FEATURE (16)..(16): Homoarginine
  MOD_RES (38)..(38): AMIDATION

SEQ ID NO: 1181 - protein, 38 aa, Artificial Sequence; identical to SEQ ID NO: 1043
  OSK1-Cit 16,D20,A34,G36-38-amide
  MISC_FEATURE (16)..(16): Citrulline
  MOD_RES (38)..(38): AMIDATION

SEQ ID NO: 1182 - protein, 38 aa, Artificial Sequence; identical to SEQ ID NO: 1043
  OSK1- hCit16,D20,A34,G36-38-amide
  MISC_FEATURE (16)..(16): Homocitrulline
  MOD_RES (38)..(38): AMIDATION

SEQ ID NO: 1183 - protein, 38 aa, Artificial Sequence; identical to SEQ ID NO: 1043
  OSK1-Dpr 16,D20,A34,G36-38-amide
  MISC_FEATURE (16)..(16): Alpha,beta-diaminopropionoic acid
  MOD_RES (38)..(38): AMIDATION

SEQ ID NO: 1184 - protein, 38 aa, Artificial Sequence; identical to SEQ ID NO: 1043
  OSK1-Dab 16,D20,A34,G36-38-amide
  MISC_FEATURE (16)..(16): Alpha,gamma-diaminobutyric acid
  MOD_RES (38)..(38): AMIDATION

SEQ ID NO: 1185 - protein, 38 aa, Artificial Sequence; identical to SEQ ID NO: 1053
  OSK1-O16,E20-amide
  MISC_FEATURE (16)..(16): Ornithine
  MOD_RES (38)..(38): AMIDATION

SEQ ID NO: 1186 - protein, 38 aa, Artificial Sequence; identical to SEQ ID NO: 1053
  OSK1-hLys 16,E20-amide
  MISC_FEATURE (16)..(16): Hmolysine
  MOD_RES (38)..(38): AMIDATION

SEQ ID NO: 1187 - protein, 38 aa, Artificial Sequence; identical to SEQ ID NO: 1053
  OSK1-hArg 16,E20-amide
  MISC_FEATURE (16)..(16): Homoarginine
  MOD_RES (38)..(38): AMIDATION

SEQ ID NO: 1188 - protein, 38 aa, Artificial Sequence; identical to SEQ ID NO: 1053
  OSK1-Cit 16,E20-amide
  MISC_FEATURE (16)..(16): Citrulline
  MOD_RES (38)..(38): AMIDATION

SEQ ID NO: 1189 - protein, 38 aa, Artificial Sequence; identical to SEQ ID NO: 1053
  OSK1- hCit16,E20-amide
  MISC_FEATURE (16)..(16): Homocitrulline
  MOD_RES (38)..(38): AMIDATION

SEQ ID NO: 1190 - protein, 38 aa, Artificial Sequence; identical to SEQ ID NO: 1053
  OSK1-Dpr 16,E20-amide
  MISC_FEATURE (16)..(16): Alpha,beta-diaminopropionoic acid
  MOD_RES (38)..(38): AMIDATION

SEQ ID NO: 1191 - protein, 38 aa, Artificial Sequence; identical to SEQ ID NO: 1053
  OSK1-Dab 16,E20-amide
  MISC_FEATURE (16)..(16): Alpha,gamma-diaminobutyric acid
  MOD_RES (38)..(38): AMIDATION

SEQ ID NO: 1192 - protein, 38 aa, Artificial Sequence; identical to SEQ ID NO: 1059
  OSK1-O16,E20,Y36-amide
  MISC_FEATURE (16)..(16): Ornithine
  MOD_RES (38)..(38): AMIDATION

SEQ ID NO: 1193 - protein, 38 aa, Artificial Sequence; identical to SEQ ID NO: 1059
  OSK1-hLys 16,E20,Y36-amide
  MISC_FEATURE (16)..(16): Homolysine
  MOD_RES (38)..(38): AMIDATION

SEQ ID NO: 1194 - protein, 38 aa, Artificial Sequence; identical to SEQ ID NO: 1059
  OSK1-hArg 16,E20,Y36-amide
  MISC_FEATURE (16)..(16): Homoarginine
  MOD_RES (38)..(38): AMIDATION

SEQ ID NO: 1195 - protein, 38 aa, Artificial Sequence; identical to SEQ ID NO: 1059
  OSK1-Cit 16,E20,Y36-amide
  MISC_FEATURE (16)..(16): Citrulline
  MOD_RES (38)..(38): AMIDATION

SEQ ID NO: 1196 - protein, 38 aa, Artificial Sequence; identical to SEQ ID NO: 1059
  OSK1- hCit16,E20,Y36-amide
  MISC_FEATURE (16)..(16): Homocitrulline
  MOD_RES (38)..(38): AMIDATION

SEQ ID NO: 1197 - protein, 38 aa, Artificial Sequence; identical to SEQ ID NO: 1059
  OSK1-Dpr 16,E20,Y36-amide
  MISC_FEATURE (16)..(16): Alpha,beta-diaminopropionoic acid
  MOD_RES (38)..(38): AMIDATION

SEQ ID NO: 1198 - protein, 38 aa, Artificial Sequence; identical to SEQ ID NO: 1059
  OSK1-Dab 16,E20,Y36-amide
  MISC_FEATURE (16)..(16): Alpha,gamma-diaminobutyric acid
  MOD_RES (38)..(38): AMIDATION

SEQ ID NO: 1199 - protein, 38 aa, Artificial Sequence; identical to SEQ ID NO: 1066
  OSK1-O16,E20,A34-amide
  MISC_FEATURE (16)..(16): Ornithine
  MOD_RES (38)..(38): AMIDATION

SEQ ID NO: 1200 - protein, 38 aa, Artificial Sequence; identical to SEQ ID NO: 1066
  OSK1-hLys 16,E20,A34-amide
  MISC_FEATURE (16)..(16): Homolysine
  MOD_RES (38)..(38): AMIDATION

SEQ ID NO: 1201 - protein, 38 aa, Artificial Sequence; identical to SEQ ID NO: 1066
  OSK1-hArg 16,E20,A34-amide
  MISC_FEATURE (16)..(16): Homoarginine
  MOD_RES (38)..(38): AMIDATION

SEQ ID NO: 1202 - protein, 38 aa, Artificial Sequence; identical to SEQ ID NO: 1066
  OSK1-Cit 16,E20,A34-amide
  MISC_FEATURE (16)..(16): Citrulline
  MOD_RES (38)..(38): AMIDATION

SEQ ID NO: 1203 - protein, 38 aa, Artificial Sequence; identical to SEQ ID NO: 1066
  OSK1- hCit16,E20,A34-amide
  MISC_FEATURE (16)..(16): Homocitrulline
  MOD_RES (38)..(38): AMIDATION

SEQ ID NO: 1204 - protein, 38 aa, Artificial Sequence; identical to SEQ ID NO: 1066
  OSK1-Dpr 16,E20,A34-amide
  MISC_FEATURE (16)..(16): Alpha,beta-diaminopropionoic acid
  MOD_RES (38)..(38): AMIDATION

SEQ ID NO: 1205 - protein, 38 aa, Artificial Sequence; identical to SEQ ID NO: 1066
  OSK1-Dab 16,E20,A34-amide
  MISC_FEATURE (16)..(16): Alpha,gamma-diaminobutyric acid
  MOD_RES (38)..(38): AMIDATION

SEQ ID NO: 1206 - protein, 35 aa, Artificial Sequence; identical to SEQ ID NO: 1073
  Delta36-38, OSK1-O16,E20, -amide
  MISC_FEATURE (16)..(16): Ornithine
  MOD_RES (35)..(35): AMIDATION

SEQ ID NO: 1207 - protein, 35 aa, Artificial Sequence; identical to SEQ ID NO: 1073
  D36-38, OSK1-hLys 16,E20-amide
  MISC_FEATURE (16)..(16): Homolysine
  MOD_RES (35)..(35): AMIDATION

SEQ ID NO: 1208 - protein, 35 aa, Artificial Sequence; identical to SEQ ID NO: 1073
  Delta36-38, OSK1-hArg 16,E20-amide
  MISC_FEATURE (16)..(16): Homoarginine
  MOD_RES (35)..(35): AMIDATION

SEQ ID NO: 1209 - protein, 35 aa, Artificial Sequence; identical to SEQ ID NO: 1073
  Delta36-38, OSK1-Cit 16,E20-amide
  MISC_FEATURE (16)..(16): Citrulline
  MOD_RES (35)..(35): AMIDATION

SEQ ID NO: 1210 - protein, 35 aa, Artificial Sequence; identical to SEQ ID NO: 1073
  Delta36-38, OSK1- hCit16,E20-amide
  MISC_FEATURE (16)..(16): Homocitrulline
  MOD_RES (35)..(35): AMIDATION

SEQ ID NO: 1211 - protein, 35 aa, Artificial Sequence; identical to SEQ ID NO: 1073
  Delta36-38, OSK1-Dpr 16,E20-amide
  MISC_FEATURE (16)..(16): Alpha,beta-diaminopropionoic acid
  MOD_RES (35)..(35): AMIDATION

SEQ ID NO: 1212 - protein, 35 aa, Artificial Sequence; identical to SEQ ID NO: 1079
  Delta36-38, OSK1-O16,E20,A34-amide
  MISC_FEATURE (16)..(16): Ornithine
  MOD_RES (35)..(35): AMIDATION

SEQ ID NO: 1213 - protein, 35 aa, Artificial Sequence; identical to SEQ ID NO: 1079
  Delta36-38, OSK1-hLys16,E20,A34-amide
  MISC_FEATURE (16)..(16): Homolysine
  MOD_RES (35)..(35): AMIDATION

SEQ ID NO: 1214 - protein, 35 aa, Artificial Sequence; identical to SEQ ID NO: 1079
  Delta36-38, OSK1-hArg16,E20,A34-amide
  MISC_FEATURE (16)..(16): Homoarginine
  MOD_RES (35)..(35): AMIDATION

SEQ ID NO: 1215 - protein, 35 aa, Artificial Sequence; identical to SEQ ID NO: 1079
  Delta36-38, OSK1-Cit 16,E20,A34-amide
  MISC_FEATURE (16)..(16): Citrulline
  MOD_RES (35)..(35): AMIDATION

SEQ ID NO: 1216 - protein, 35 aa, Artificial Sequence; identical to SEQ ID NO: 1073
  Delta36-38, OSK1- hCit16,E20,A34-amide
  MISC_FEATURE (16)..(16): Homocitrulline
  MOD_RES (35)..(35): AMIDATION

SEQ ID NO: 1217 - protein, 35 aa, Artificial Sequence; identical to SEQ ID NO: 1079
  Delta36-38, OSK1-Dpr 16,E20,A34-amide
  MISC_FEATURE (16)..(16): Alpha,beta-diaminopropionoic acid
  MOD_RES (35)..(35): AMIDATION

SEQ ID NO: 1218 - protein, 35 aa, Artificial Sequence; identical to SEQ ID NO: 1079
  Delta36-38, OSK1-Dab 16,E20,A34-amide
  MISC_FEATURE (16)..(16): Alpha,gamma-diaminobutyric acid
  MOD_RES (35)..(35): AMIDATION

SEQ ID NO: 1219 - protein, 38 aa, Artificial Sequence
  OSK1-O16,E20,W36,G37,G38-amide
  MOD_RES (38)..(38): AMIDATION
GVIINVKCKISRQCLKPCKEAGMRFGKCMNGKCHCWGG

SEQ ID NO: 1220 - protein, 38 aa, Artificial Sequence; identical to SEQ ID NO: 1087
  OSK1-O16,E20,Y36,G37,G38-amide
  MISC_FEATURE (16)..(16): Ornithine
  MOD_RES (38)..(38): AMIDATION

SEQ ID NO: 1221 - protein, 38 aa, Artificial Sequence; identical to SEQ ID NO: 1087
  OSK1-hLys 16,E20,Y36,G37,G38-amide
  MISC_FEATURE (16)..(16): Homolysine
  MOD_RES (38)..(38): AMIDATION

SEQ ID NO: 1222 - protein, 38 aa, Artificial Sequence; identical to SEQ ID NO: 1087
  OSK1-hArg 16,E20,Y36,G37,G38-amide
  MISC_FEATURE (16)..(16): Homoarginine
  MOD_RES (38)..(38): AMIDATION

SEQ ID NO: 1223 - protein, 38 aa, Artificial Sequence; identical to SEQ ID NO: 1087
  OSK1-Cit 16,E20,Y36,G37,G38-amide
  MISC_FEATURE (16)..(16): Citrulline
  MOD_RES (38)..(38): AMIDATION

SEQ ID NO: 1224 - protein, 38 aa, Artificial Sequence; identical to SEQ ID NO: 1087
  OSK1-hCit 16,E20,Y36,G37,G38-amide
  MISC_FEATURE (16)..(16): Homocitrulline
  MOD_RES (38)..(38): AMIDATION

SEQ ID NO: 1225 - protein, 38 aa, Artificial Sequence; identical to SEQ ID NO: 1087
  OSK1-Dpr 16,E20,Y36,G37,G38-amide
  MISC_FEATURE (16)..(16): Alpha,beta-diaminopropionoic acid
  MOD_RES (38)..(38): AMIDATION

SEQ ID NO: 1226 - protein, 38 aa, Artificial Sequence; identical to SEQ ID NO: 1087
  OSK1-Dpr 16,E20,Y36,G37,G38-amide
  MISC_FEATURE (16)..(16): Alpha,gamma-diaminobutyric acid
  MOD_RES (38)..(38): AMIDATION

SEQ ID NO: 1227 - protein, 38 aa, Artificial Sequence
  OSK1-K16,E20,A34,Y36,G37,G38-amide
  MOD_RES (38)..(38): AMIDATION
GVIINVKCKISRQCLKPCKEAGMRFGKCMNGKCACYGG

SEQ ID NO: 1228 - protein, 38 aa, Artificial Sequence; identical to SEQ ID NO: 1097
  OSK1-O16,E20,A34,Y36,G37,G38-amide
  MISC_FEATURE (16)..(16): Ornithine
  MOD_RES (38)..(38): AMIDATION

SEQ ID NO: 1229 - protein, 38 aa, Artificial Sequence; identical to SEQ ID NO: 1097
  OSK1-hLys 16,E20,A34,Y36,G37,G38-amide
  MISC_FEATURE (16)..(16): Homolysine
  MOD_RES (38)..(38): AMIDATION

SEQ ID NO: 1230 - protein, 38 aa, Artificial Sequence; identical to SEQ ID NO: 1097
  OSK1-hArg 16,E20,A34,Y36,G37,G38-amide
  MISC_FEATURE (16)..(16): Homoarginine
  MOD_RES (38)..(38): AMIDATION

SEQ ID NO: 1231 - protein, 38 aa, Artificial Sequence; identical to SEQ ID NO: 1097
  OSK1-Cit 16,E20,A34,Y36,G37,G38-amide
  MISC_FEATURE (16)..(16): Citrulline
  MOD_RES (38)..(38): AMIDATION

SEQ ID NO: 1232 - protein, 38 aa, Artificial Sequence; identical to SEQ ID NO: 1087
  OSK1- hCit 16,E20,A34,Y3,G37,G38-amide
  MISC_FEATURE (16)..(16): Homocitrulline
  MOD_RES (38)..(38): AMIDATION

SEQ ID NO: 1233 - protein, 38 aa, Artificial Sequence; identical to SEQ ID NO: 1097
  OSK1-Dpr 16,E20,A34,Y36,G37,G38-amide
  MISC_FEATURE (16)..(16): Alpha,beta-diaminopropionoic acid
  MOD_RES (38)..(38): AMIDATION

SEQ ID NO: 1234 - protein, 38 aa, Artificial Sequence; identical to SEQ ID NO: 1097
  OSK1-Dab 16,E20,A34,Y36,G37,G38-amide
  MISC_FEATURE (16)..(16): Alpha,gamma-diaminobutyric acid
  MOD_RES (38)..(38): AMIDATION

SEQ ID NO: 1235 - protein, 38 aa, Artificial Sequence; identical to SEQ ID NO: 1105
  OSK1-O16,E20,G36-38-amide
  MISC_FEATURE (16)..(16): Ornithine
  MOD_RES (38)..(38): AMIDATION

SEQ ID NO: 1236 - protein, 38 aa, Artificial Sequence; identical to SEQ ID NO: 1105
  OSK1-hLys 16,E20,G36-38-amide
  MISC_FEATURE (16)..(16): Homolysine
  MOD_RES (38)..(38): AMIDATION

SEQ ID NO: 1237 - protein, 38 aa, Artificial Sequence; identical to SEQ ID NO: 1105
  OSK1-hArg 16,E20,G36-38-amide
  MISC_FEATURE (16)..(16): Homoarginine
  MOD_RES (38)..(38): AMIDATION

SEQ ID NO: 1238 - protein, 38 aa, Artificial Sequence; identical to SEQ ID NO: 1105
  OSK1-Cit 16,E20,G36-38-amide
  MISC_FEATURE (16)..(16): Citrulline
  MOD_RES (38)..(38): AMIDATION

SEQ ID NO: 1239 - protein, 38 aa, Artificial Sequence; identical to SEQ ID NO: 1105
  OSK1-hCit 16,E20,G36-38-amide
  MISC_FEATURE (16)..(16): Homocitrulline
  MOD_RES (38)..(38): AMIDATION

SEQ ID NO: 1240 - protein, 38 aa, Artificial Sequence; identical to SEQ ID NO: 1105
  OSK1-Dpr 16,E20,G36-38-amide
  MISC_FEATURE (16)..(16): Alpha,beta-diaminopropionoic acid
  MOD_RES (38)..(38): AMIDATION

SEQ ID NO: 1241 - protein, 38 aa, Artificial Sequence; identical to SEQ ID NO: 1111
  OSK1-O16,E20,A34,G36-38-amide
  MISC_FEATURE (16)..(16): Ornithine
  MOD_RES (38)..(38): AMIDATION

SEQ ID NO: 1242 - protein, 38 aa, Artificial Sequence; identical to SEQ ID NO: 1111
  OSK1-hLys 16,E20,A34,G36-38-amide
  MISC_FEATURE (16)..(16): Homolysine
  MOD_RES (38)..(38): AMIDATION

SEQ ID NO: 1243 - protein, 38 aa, Artificial Sequence; identical to SEQ ID NO: 1111
  OSK1-hArg 16,E20,A34,G36-38-amide
  MISC_FEATURE (16)..(16): Homoarginine
  MOD_RES (38)..(38): AMIDATION

SEQ ID NO: 1244 - protein, 38 aa, Artificial Sequence; identical to SEQ ID NO: 1111
  OSK1-Cit 16,E20,A34,G36-38-amide
  MISC_FEATURE (16)..(16): Citrulline
  MOD_RES (38)..(38): AMIDATION

SEQ ID NO: 1245 - protein, 37 aa, Artificial Sequence; identical to SEQ ID NO: 1115
  Delta38 OSK1-hCit 16,E20,A34-amide
  MISC_FEATURE (16)..(16): Homocitrulline
  MOD_RES (37)..(37): AMIDATION

SEQ ID NO: 1246 - protein, 38 aa, Artificial Sequence; identical to SEQ ID NO: 1111
  OSK1-Dpr 16,E20,A34,G36-38-amide
  MISC_FEATURE (16)..(16): Alpha,beta-diaminopropionoic acid
  MOD_RES (38)..(38): AMIDATION

SEQ ID NO: 1247 - protein, 38 aa, Artificial Sequence; identical to SEQ ID NO: 1111
  OSK1-Dab 16,E20,A34,G36-38-amide
  MISC_FEATURE (16)..(16): Alpha,gamma-diaminobutyric acid
  MOD_RES (38)..(38): AMIDATION

SEQ ID NO: 1248 - protein, 38 aa, Artificial Sequence
  OSK1-K 16,CPA20,A34,Y36,G37,G38-amide
  MISC_FEATURE (20)..(20): p-carboxyl-phenylalanine
  MOD_RES (38)..(38): AMIDATION
GVIINVKCKISRQCLKPCKXAGMRFGKCMNGKCACYGG

SEQ ID NO: 1249 - protein, 38 aa, Artificial Sequence
  OSK1-K 16,CPA20,A34,G36-38-amide
  MISC_FEATURE (20)..(20): p-carboxyl-phenylalanine
  MOD_RES (38)..(38): AMIDATION
GVIINVKCKISRQCLKPCKXAGMRFGKCMNGKCACGGG

SEQ ID NO: 1250 - protein, 36 aa, Artificial Sequence
  Delta37-38OSK1-K 16,CPA20,A34,Y36-amide
  MISC_FEATURE (20)..(20): p-carboxyl-phenylalanine
  MOD_RES (36)..(36): AMIDATION
GVIINVKCKISRQCLKPCKXAGMRFGKCMNGKCACY

SEQ ID NO: 1251 - protein, 38 aa, Artificial Sequence; identical to SEQ ID NO: 1027
  Acetyl-OSK1-K 16,D20,A34,Y36,G37,G38-amide
  MOD_RES (1)..(1): ACETYLATION
  MOD_RES (38)..(38): AMIDATION

SEQ ID NO: 1252 - protein, 38 aa, Artificial Sequence; identical to SEQ ID NO: 1248
  OSK1-K 16, Aad20,A34,Y36,G37,G38-amide
  MISC_FEATURE (20)..(20): Alpha-aminoadipic acid
  MOD_RES (38)..(38): AMIDATION

SEQ ID NO: 1253 - protein, 38 aa, Artificial Sequence
  OSK1-K 16, Aad20,Y36,G37,G38-amide
  MISC_FEATURE (20)..(20): Alpha-aminoadipic acid
  MOD_RES (38)..(38): AMIDATION
GVIINVKCKISRQCLKPCKXAGMRFGKCMNGKCHCYGG

SEQ ID NO: 1254 - protein, 38 aa, Artificial Sequence; identical to SEQ ID NO: 1248
  OSK1-K 16, Aad20,A34,Y36,G37,G38
  MISC_FEATURE (20)..(20): Alpha-aminoadipic acid

SEQ ID NO: 1255 - protein, 38 aa, Artificial Sequence
  OSK1-H 16,D20,A34,Y36,G37,G38-amide
  MOD_RES (38)..(38): AMIDATION
GVIINVKCKISRQCLHPCKDAGMRFGKCMNGKCACYGG

SEQ ID NO: 1256 - protein, 38 aa, Artificial Sequence; identical to SEQ ID NO: 1255
  OSK1-H 16,D20,A34,Y36,G37,G38

SEQ ID NO: 1257 - protein, 36 aa, Artificial Sequence
  Delta37-38-OSK1-H 16,D20,A34,Y36-amide
  MOD_RES (36)..(36): AMIDATION
GVIINVKCKISRQCLHPCKDAGMRFGKCMNGKCACY

SEQ ID NO: 1258 - protein, 38 aa, Artificial Sequence
  OSK1-H 16,D20,A34,Y36,G37,G38-amide
  MOD_RES (38)..(38): AMIDATION
GVIINVKCKISRQCLHPCKDAGMRFGKCMNGKCHCYGG

SEQ ID NO: 1259 - protein, 38 aa, Artificial Sequence; identical to SEQ ID NO: 1258
  OSK1-H 16,D20,A34,Y36,G37,G38

SEQ ID NO: 1260 - protein, 38 aa, Artificial Sequence
  OSK1-H 16,D20,A34,Y36,
GVIINVKCKISRQCLHPCKDAGMRFGKCMNGKCHCYPK

SEQ ID NO: 1261 - protein, 35 aa, Artificial Sequence
  Delta36-38 OSK1-H 16,D20,A34,Y36,
GVIINVKCKISRQCLHPCKDAGMRFGKCMNGKCAC

SEQ ID NO: 1262 - protein, 38 aa, Artificial Sequence
  OSK1-K 16,D20,A34,1Nal36,G37,G38-amide
  MISC_FEATURE (36)..(36): Beta-(1-Naphthyl)-alanine
  MOD_RES (38)..(38): AMIDATION
GVIINVKCKISRQCLKPCKDAGMRFGKCMNGKCACXGG

SEQ ID NO: 1263 - protein, 38 aa, Artificial Sequence
  OSK1-K 16,D20,A34,1Nal36-amide
  MISC_FEATURE (36)..(36): Beta-(1-Naphthyl)-alanine
  MOD_RES (38)..(38): AMIDATION
GVIINVKCKISRQCLKPCKDAGMRFGKCMNGKCACXPK

SEQ ID NO: 1264 - protein, 38 aa, Artificial Sequence; identical to SEQ ID NO: 1262
  OSK1-K 16,D20,A34,2Nal36,G37,G38-amide
  MISC_FEATURE (36)..(36): Beta-(2-Naphthyl)-alanine
  MOD_RES (38)..(38): AMIDATION

SEQ ID NO: 1265 - protein, 38 aa, Artificial Sequence; identical to SEQ ID NO: 1262
  OSK1-K 16,D20,A34,Cha36,G37,G38-amide
  MISC_FEATURE (36)..(36): Cyclohexylalanine
  MOD_RES (38)..(38): AMIDATION

SEQ ID NO: 1266 - protein, 38 aa, Artificial Sequence; identical to SEQ ID NO: 1262
  OSK1-K 16,D20,A34, MePhe36,G37,G38-amide
  MISC_FEATURE (36)..(36): 4-methyl-phenylalanine
  MOD_RES (38)..(38): AMIDATION

SEQ ID NO: 1267 - protein, 38 aa, Artificial Sequence; identical to SEQ ID NO: 1262
  OSK1-K 16,D20,A34, BiPhA36,G37,G38-amide
  MISC_FEATURE (36)..(36): Beta,beta-diphenyl-alanine
  MOD_RES (38)..(38): AMIDATION

SEQ ID NO: 1268 - protein, 38 aa, Artificial Sequence
  OSK1-K 16,D20, Aib34,Y36,G37,G38-amide
  MISC_FEATURE (34)..(34): Alpha-amino-isobutyric acid
  MOD_RES (38)..(38): AMIDATION
GVIINVKCKISRQCLKPCKDAGMRFGKCMNGKCXCYGG

SEQ ID NO: 1269 - protein, 38 aa, Artificial Sequence; identical to SEQ ID NO: 1268
  OSK1-K 16,D20, Abu34,Y36,G37,G38-amide
  MISC_FEATURE (34)..(34): Aminobutyric acid
  MOD_RES (38)..(38): AMIDATION

SEQ ID NO: 1270 - protein, 36 aa, Artificial Sequence
  Delta37-38 OSK1-H 16,D20,A34,1Nal36, -amide
  MISC_FEATURE (36)..(36): Beta-(1-Naphthyl)-alanine
GVIINVKCKISRQCLKPCKDAGMRFGKCMNGKCACX

SEQ ID NO: 1271 - protein, 38 aa, Artificial Sequence
  OSK1-H 16,D20,A34, 1Nal36,G37,G38-amide
  MISC_FEATURE (36)..(36): Beta-(1-Naphthyl)-alanine
  MOD_RES (38)..(38): AMIDATION
GVIINVKCKISRQCLHPCKDAGMRFGKCMNGKCACXGG

SEQ ID NO: 1272 - protein, 36 aa, Artificial Sequence; identical to SEQ ID NO: 1270
  Delta37-38 OSK1-H 16,D20,A34, 4Bip 36,-amide
  MISC_FEATURE (36)..(36): 4-phenyl-phenylalanine
  MOD_RES (36)..(36): AMIDATION

SEQ ID NO: 1273 - protein, 38 aa, Artificial Sequence; identical to SEQ ID NO: 1271
  OSK1-H 16,D20,A34, 4Bip 36,G37,G38-amide
  MISC_FEATURE (36)..(36): 4-phenyl-phenylalanine
  MOD_RES (38)..(38): AMIDATION

SEQ ID NO: 1274 - protein, 38 aa, Artificial Sequence
  OSK1-K16,E20,G36-38
GVIINVKCKISRQCLKPCKDAGMRFGKCMNGKCHCGGG

SEQ ID NO: 1275 - protein, 38 aa, Artificial Sequence
  U-Aga-3
ADCVGDGQRCADWAGPYCCSGYYCSCRSMPYCRCRSDS

SEQ ID NO: 1276 - protein, 63 aa, Parabuthus transvaalicus
  MISC_FEATURE: Kurtoxin
KIDGYPVDYWNCKRICWYNNKYCNDLCKGLKADSGYCWGWTLSCYCQGLPDNARIKRSGRCRA

SEQ ID NO: 1277 - protein, 77 aa, Artificial Sequence
  Tx-1
AELTSCFPVGHECDGDASNCNCCGDDVYCGCGWGRWNCKCKVADQSYAYGICKDKVNCPNRHLWPAKVCKKPCRREC

SEQ ID NO: 1278 - protein, 34 aa, Artificial Sequence
  Tx3-3
  misc_feature (31)..(31): Xaa can be any naturally occurring amino acid
GCANAYKSCNGPHTCCWGYNGYKKACICSGXNWK

SEQ ID NO: 1279 - protein, 40 aa, Artificial Sequence
  Tx3-4
SCINVGDFCDGKKDCCQCDRDNAFCSCSVIFGYKTNCRCE

SEQ ID NO: 1280 - protein, 76 aa, Artificial Sequence
  omega-PtXIIA
SCINVGDFCDGKKDDCQCCRDNAFCSCSVIFGYKTNCRCEVGTTATSYGICMAKHKCGRQTTCTKPCLSKRCKKNH

SEQ ID NO: 1281 - protein, 74 aa, Artificial Sequence
  Dw13.3
AECLMIGDTSCVPRLGRRCCYGAWCYCDQQLSCRRVGRKRECGWVEVNCKCGWSWSQRIDDWRADYSCKCPEDQ

SEQ ID NO: 1282 - protein, 35 aa, Artificial Sequence
  Agelenin
GGCLPHNRFCNALSGPRCCSGLKCKELSIWDSRCL

SEQ ID NO: 1283 - protein, 36 aa, Artificial Sequence
  omega-GTx-SIA
DCVRFWGKCSQTSDCCPHLACKSKWPRNICVWDGSV

SEQ ID NO: 1284 - protein, 31 aa, Conus pennaceus
  MISC_FEATURE: omega-conotoxin PnVIA
GCLEVDYFCGIPFANNGLCCSGNCVFVCTPQ

SEQ ID NO: 1285 - protein, 30 aa, Conus pennaceus
  MISC_FEATURE: omega-conotoxin PnVIB
DDDCEPPGNFCGMIKIGPPCCSGWCFFACA

SEQ ID NO: 1286 - protein, 11 aa, Conus marmoreus
  MISC_FEATURE: Lambda-conotoxin CMrVIA
VCCGYKLCHPC

SEQ ID NO: 1287 - protein, 61 aa, Conus marmoreus
  MISC_FEATURE: Lambda-conotoxin CMrVIB
MRCLPVLIILLLLTASAPGVVVLPKTEDDVPMSSVYGNGKSILRGILRNGVCCGYKLCHPC

SEQ ID NO: 1288 - protein, 77 aa, Phoneutria nigriventer; identical to SEQ ID NO: 1277
  MISC_FEATURE: Tx1

SEQ ID NO: 1289 - protein, 34 aa, Phoneutria nigriventer; identical to SEQ ID NO: 1278
  MISC_FEATURE: Tx3-3
  misc_feature (31)..(31): Xaa can be any naturally occurring amino acid

SEQ ID NO: 1290 - protein, 40 aa, Phoneutria nigriventer; identical to SEQ ID NO: 1279
  MISC_FEATURE: Tx3-4

SEQ ID NO: 1291 - protein, 76 aa, Phoneutria nigriventer; identical to SEQ ID NO: 1280
  MISC_FEATURE: omega-PtXIIA

SEQ ID NO: 1292 - protein, 74 aa, Filistata hibernalis; identical to SEQ ID NO: 1281
  MISC_FEATURE: Dw13.3

SEQ ID NO: 1293 - protein, 35 aa, Agelena opulenta; identical to SEQ ID NO: 1282
  MISC_FEATURE: Agelenin

SEQ ID NO: 1294 - protein, 36 aa, Grammostola spatulata; identical to SEQ ID NO: 1283
  MISC_FEATURE: omega-GTx-SIA

SEQ ID NO: 1295 - protein, 35 aa, Artificial Sequence
  ShK Q1/A4/A15
QSCADTIPKSRCTAAQCKHSMKYRLSFCRKTCGTC

SEQ ID NO: 1296 - protein, 35 aa, Artificial Sequence
  ShK Q1/A4/A15/A22
QSCADTIPKSRCTAAQCKHSMAYRLSFCRKTCGTC

SEQ ID NO: 1297 - protein, 35 aa, Artificial Sequence
  ShK Q1/A4/A15/Dap22
  MISC_FEATURE (22)..(22): Diaminopropionic acid
QSCADTIPKSRCTAAQCKHSMXYRLSFCRKTCGTC

SEQ ID NO: 1298 - protein, 35 aa, Artificial Sequence
  ShK Q1/A4/A15/A25
QSCADTIPKSRCTAAQCKHSMKYRASFCRKTCGTC

SEQ ID NO: 1299 - protein, 35 aa, Artificial Sequence
  ShK Q1/A4/A15/A22/A25
QSCADTIPKSRCTAAQCKHSMAYRASFCRKTCGTC

SEQ ID NO: 1300 - protein, 35 aa, Artificial Sequence
  ShK Q1/A4/A15/Dap22/A25
  MISC_FEATURE (22)..(22): Diaminopropionic acid
QSCADTIPKSRCTAAQCKHSMXYRASFCRKTCGTC

SEQ ID NO: 1301 - protein, 34 aa, Artificial Sequence
  MTX-R4
VSCRGSKDCYAPCRKQTGCPNAKCINKSCKCYGC

SEQ ID NO: 1302 - protein, 34 aa, Artificial Sequence
  MTX-G4
VSCGGSKDCYAPCRKQTGCPNAKCINKSCKCYGC

SEQ ID NO: 1303 - protein, 38 aa, Artificial Sequence
  OSK1-S7
GVIINVSCKISRQCLEPCKKAGMRFGKCMNGKCHCTPK

SEQ ID NO: 1304 - protein, 34 aa, Artificial Sequence
  MTX-T5
VSCTTSKDCYAPCRKQTGCPNAKCINKSCKCYGC

SEQ ID NO: 1305 - protein, 34 aa, Artificial Sequence
  MTX-A5
VSCTASKDCYAPCRKQTGCPNAKCINKSCKCYGC

SEQ ID NO: 1306 - protein, 34 aa, Artificial Sequence
  MTX-T6
VSCTGTKDCYAPCRKQTGCPNAKCINKSCKCYGC

SEQ ID NO: 1307 - protein, 34 aa, Artificial Sequence
  MTX-P6
VSCTGPKDCYAPCRKQTGCPNAKCINKSCKCYGC

SEQ ID NO: 1308 - protein, 38 aa, Artificial Sequence
  OSK1-S7,K16,D20
GVIINVSCKISRQCLKPCKDAGMRFGKCMNGKCHCTPK

SEQ ID NO: 1309 - protein, 34 aa, Artificial Sequence
  MTX-G10
VSCTGSKDCGAPCRKQTGCPNAKCINKSCKCYGC

SEQ ID NO: 1310 - DNA, 63 bp, Artificial Sequence
  Oligonucleotide duplex
accagcttttttgcacggttccaggcactgacgggagattttgcatttaacgttgatgataac

SEQ ID NO: 1311 - protein, 34 aa, Artificial Sequence
  MTX-R11
VSCTGSKDCYRPCRKQTGCPNAKCINKSCKCYGC

SEQ ID NO: 1312 - protein, 34 aa, Artificial Sequence
  MTX-D11
VSCTGSKDCYDPCRKQTGCPNAKCINKSCKCYGC

SEQ ID NO: 1313 - DNA, 83 bp, Artificial Sequence
  Oligonucleotide duplex
gggtcgttcttgtattgatactattccaaaatctcgttgtactgcttttcaatgtaaacattctatgaaatatcgtctttctt

SEQ ID NO: 1314 - DNA, 44 bp, Artificial Sequence; identical to SEQ ID NO: 762
  Oligonucleotide duplex

SEQ ID NO: 1315 - protein, 34 aa, Artificial Sequence
  MTX-R16
VSCTGSKDCYAPCRKRTGCPNAKCINKSCKCYGC

SEQ ID NO: 1316 - protein, 34 aa, Artificial Sequence
  MTX-E16
VSCTGSKDCYAPCRKETGCPNAKCINKSCKCYGC

SEQ ID NO: 1317 - protein, 34 aa, Artificial Sequence
  MTX-Y21
VSCTGSKDCYAPCRKQTGCPYAKCINKSCKCYGC

SEQ ID NO: 1318 - protein, 34 aa, Artificial Sequence
  MTX-S22
VSCTGSKDCYAPCRKQTGCPNSKCINKSCKCYGC

SEQ ID NO: 1319 - protein, 34 aa, Artificial Sequence
  MTX-G22
VSCTGSKDCYAPCRKQTGCPNGKCINKSCKCYGC

SEQ ID NO: 1320 - protein, 34 aa, Artificial Sequence
  MTX-R27
VSCTGSKDCYAPCRKQTGCPNAKCINRSCKCYGC

SEQ ID NO: 1321 - protein, 34 aa, Artificial Sequence
  MTX-T28
VSCTGSKDCYAPCRKQTGCPNAKCINKTCKCYGC

SEQ ID NO: 1322 - protein, 34 aa, Artificial Sequence
  MTX-M28
VSCTGSKDCYAPCRKQTGCPNAKCINKMCKCYGC

SEQ ID NO: 1323 - protein, 34 aa, Artificial Sequence
  MTX-K28
VSCTGSKDCYAPCRKQTGCPNAKCINKKCKCYGC

SEQ ID NO: 1324 - protein, 34 aa, Artificial Sequence
  MTX-N32
VSCTGSKDCYAPCRKQTGCPNAKCINKSCKCNGC

SEQ ID NO: 1325 - protein, 34 aa, Artificial Sequence
  MTX-R33
VSCTGSKDCYAPCRKQTGCPNAKCINKSCKCYRC

SEQ ID NO: 1326 - protein, 35 aa, Artificial Sequence
  MTX-S35
VSCTGSKDCYAPCRKQTGCPNAKCINKSCKCYGCS

SEQ ID NO: 1327 - protein, 33 aa, Artificial Sequence
  MTX-d1
SCTGSKDCYAPCRKQTGCPNAKCINKSCKCYGC

SEQ ID NO: 1328 - protein, 34 aa, Artificial Sequence
  MTX-S35 d1
SCTGSKDCYAPCRKQTGCPNAKCINKSCKCYGCS

SEQ ID NO: 1329 - protein, 34 aa, Artificial Sequence
  MTX-A14
VSCTGSKDCYAPCAKQTGCPNAKCINKSCKCYGC

SEQ ID NO: 1330 - protein, 34 aa, Artificial Sequence
  MTX-A15
VSCTGSKDCYAPCRAQTGCPNAKCINKSCKCYGC

SEQ ID NO: 1331 - protein, 34 aa, Artificial Sequence
  MTX-A23
VSCTGSKDCYAPCRKQTGCPNAACINKSCKCYGC

SEQ ID NO: 1332 - protein, 34 aa, Artificial Sequence
  MTX-A27
VSCTGSKDCYAPCRKQTGCPNAKCINASCKCYGC

SEQ ID NO: 1333 - protein, 34 aa, Artificial Sequence
  MTX-A30
VSCTGSKDCYAPCRKQTGCPNAKCINKSCACYGC

SEQ ID NO: 1334 - protein, 34 aa, Artificial Sequence
  MTX-A32
VSCTGSKDCYAPCRKQTGCPNAKCINKSCKCAGC

SEQ ID NO: 1335 - protein, 34 aa, Artificial Sequence
  MTX-A1
ASCTGSKDCYAPCRKQTGCPNAKCINKSCKCYGC

SEQ ID NO: 1336 - protein, 34 aa, Artificial Sequence
  MTX-M1
MSCTGSKDCYAPCRKQTGCPNAKCINKSCKCYGC

SEQ ID NO: 1337 - protein, 219 aa, Artificial Sequence
  Chloramphenicol Acetyltransferase (product of the cat gene)
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVANMDNFFAPVFTMGKYYTQGDKVLMPLAIQVHHAVCDGFHVGRMLNELQQYCDEWQGGA

SEQ ID NO: 1338 - protein, 124 aa, Artificial Sequence
  Zeocin Resistance Protein (product of the ble gene)
MAKLTSAVPVLTARDVAGAVEFWTDRLGFSRDFVEDDFAGVVRDDVTLFISAVQDQVVPDNTLAWVWVRGLDELYAEWSEVVSTNFRDASGPAMTEIGEQPWGREFALRDPAGNCVHFVAEEQD

SEQ ID NO: 1339 - DNA, 1192 bp, Artificial Sequence
  Cloning vector pAMG21ampR-Pep-Fc
  CDS (4)..(9)
  CDS (66)..(83)
  CDS (87)..(461)
  CDS (487)..(1182)
catatgggtcgagacggggcggtgttgacaattaatcatcggcatagtatatcggcatagtataatacgacaaggtgaggaactaaaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtccgacggcggcgtctcaggtggtggtggtggtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaataatggatcc

SEQ ID NO: 1340 - protein, 6 aa, Artificial Sequence
  Synthetic Construct
YDKVRN

SEQ ID NO: 1341 - protein, 125 aa, Artificial Sequence
  Synthetic Construct
TMAKLTSAVPVLTARDVAGAVEFWTDRLGFSRDFVEDDFAGVVRDDVTLFISAVQDQVVPDNTLAWVWVRGLDELYAEWSEVVSTNFRDASGPAMTEIGEQPWGREFALRDPAGNCVHFVAEEQD

SEQ ID NO: 1342 - protein, 232 aa, Artificial Sequence; identical to SEQ ID NO: 74
  Synthetic Construct

SEQ ID NO: 1343 - DNA, 10 bp, Artificial Sequence
  Peptide duplex
aataacatat

SEQ ID NO: 1344 - DNA, 11 bp, Artificial Sequence
  Peptide duplex
gggtcgagacg

SEQ ID NO: 1345 - DNA, 14 bp, Artificial Sequence
  Peptide duplex
ttattgtataccca

SEQ ID NO: 1346 - DNA, 11 bp, Artificial Sequence
  Peptide duplex
gcagagtccac

SEQ ID NO: 1347 - DNA, 73 bp, Artificial Sequence
  Oligonucleotide duplex
gggtgttatcatcaacgttaaatgcaaaatctcccgtcagtgcctggaaccgtgcaaaaaagctggtatgcgt

SEQ ID NO: 1348 - DNA, 60 bp, Artificial Sequence
  Oligonucleotide duplex
ttcggtaaatgcatgaacggtaaatgccactgcaccccgaaatctggtggtggtggttct

SEQ ID NO: 1349 - DNA, 73 bp, Artificial Sequence
  Oligonucleotide duplex
caccagaaccaccaccaccaccagatttcggggtgcagtggcatttaccgttcatgcatttaccgaaacgcat

SEQ ID NO: 1350 - DNA, 133 bp, Artificial Sequence
  Oligonucleotide duplex
  misc_feature (1)..(4): Single-stranded DNA in positions 1-4.
  CDS (2)..(133)
gggtgttatcatcaacgttaaatgcaaaatctcccgtcagtgcctggaaccgtgcaaaaaagctggtatgcgtttcggtaaatgcatgaacggtaaatgccactgcaccccgaaatctggtggtggtggttct

SEQ ID NO: 1351 - protein, 44 aa, Artificial Sequence
  Synthetic Construct
GVIINVKCKISRQCLEPCKKAGMRFGKCMNGKCHCTPKSGGGGS

SEQ ID NO: 1352 - DNA, 133 bp, Artificial Sequence
  Oligonucleotide duplex
  misc_feature (1)..(4): Single-stranded DNA in positions 1-4.
caccagaaccaccaccaccagatttcggggtgcagtggcatttaccgttcatgcatttaccgaaacgcataccagcttttttgcacggttccaggcactgacgggagattttgcatttaacgttgatgataac

SEQ ID NO: 1353 - DNA, 83 bp, Artificial Sequence; identical to SEQ ID NO: 763
  Oligonucleotide duplex

SEQ ID NO: 1354 - DNA, 44 bp, Artificial Sequence; identical to SEQ ID NO: 764
  Oligonucleotide duplex

SEQ ID NO: 1355 - DNA, 127 bp, Artificial Sequence
  Oligonucleotide duplex
  misc_feature (1)..(4): Single-stranded DNA in positions 1-4.
  CDS (2)..(127)
gggtcgttcttgtattgatactattccaaaatctcgttgtactgcttttcaatgtaaacattctatgaaatatcgtctttctttttgtcgtaaaacttgtggtacttgttctggtggtggtggttct

SEQ ID NO: 1356 - protein, 42 aa, Artificial Sequence
  Synthetic Construct
GRSCIDTIPKSRCTAFQCKHSMKYRLSFCRKTCGTCSGGGGS

SEQ ID NO: 1357 - DNA, 127 bp, Artificial Sequence; identical to SEQ ID NO: 767
  Oligonucleotide duplex
  misc_feature (1)..(4): Single-stranded DNA in positions 1-4.

SEQ ID NO: 1358 - DNA, 1530 bp, Artificial Sequence
  Nucleic acid and amino acid sequences of pAMG21ampR-Fc-pep
  CDS (4)..(702)
  CDS (824)..(1480)
catatggacaaaactcacacatgtccaccttgtccagctccggaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggtggaggtggtggttgagacgctgcaggacgttgatcggcacgtaagaggttccaactttcaccataatgaaataagatcactaccgggcgtattttttgagttatcgagattttcaggagctaaggaagccaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctatggagtgaataccacgacgattcccggcagtttctacacatatattcgcaagatgtggcgtgttacggtgaaaacctggcctatttccctaaagggtttattgagaatatgtttttcgtttcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcggggcggggcgtaatttttttaaggcagttattggtggcgcgcccgtctcttaaggatccg

SEQ ID NO: 1359 - protein, 233 aa, Artificial Sequence; identical to SEQ ID NO: 70
  Synthetic Construct

SEQ ID NO: 1360 - protein, 219 aa, Artificial Sequence
  Synthetic Construct
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDSRQFLHIYSQDVACYGENLAYFPKGFIENMFFVSANPWVSFTSFDLNVANMDNFFAPVFTMGKYYTQGDKVLMPLAIQVHHAVCDGFHVGRMLNELQQYCDEWRGGA

SEQ ID NO: 1361 - DNA, 1189 bp, Artificial Sequence
  Nucleic acid and amino acid sequences of pAMG21ampR-pep-Fc
  CDS (4)..(6)
  CDS (87)..(458)
  CDS (484)..(1179)
catatgcgagacggggcggtgttgacaattaatcatcggcatagtatatcggcatagtataatacgacaaggtgaggaactaaaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtccgacggcggcgtctcaggtggtggtggtggtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaataatggatcc

SEQ ID NO: 1362 - protein, 124 aa, Artificial Sequence; identical to SEQ ID NO: 1338
  Synthetic Construct

SEQ ID NO: 1363 - protein, 232 aa, Artificial Sequence; identical to SEQ ID NO: 74
  Synthetic Construct

SEQ ID NO: 1364 - protein, 25 aa, Conus catus
  MOD_RES (25)..(25): AMIDATION
CKGKGASCRKTMYDCCRGSCRSGRC

SEQ ID NO: 1365 - protein, 26 aa, Conus catus
  MOD_RES (26)..(26): AMIDATION
CKGKGQSCSKLMYDCCTGSCSRRGKC

SEQ ID NO: 1366 - protein, 27 aa, Conus catus
  MOD_RES (27)..(27): AMIDATION
CKSKGAKCSKLMYDCCSGSCSGTVGRC

SEQ ID NO: 1367 - protein, 27 aa, Conus tulipa
  MISC_FEATURE (4)..(4): Ornithine
  MISC_FEATURE (10)..(10): Ornithine
  MISC_FEATURE (21)..(21): Ornithine
  MOD_RES (27)..(27): AMIDATION
CLSXGSSCSXTSYNCCRSCNXYSRKCY

SEQ ID NO: 1368 - protein, 26 aa, Conus magus
  MOD_RES (26)..(26): AMIDATION
CKGKGAPCRKTMYDCCSGSCGRRGKC

SEQ ID NO: 1369 - protein, 37 aa, Artificial Sequence
  ChTx-G31
QFTNVSCTTSKECWSVCQRLHNTSRGKCMNGKCRCYS

SEQ ID NO: 1370 - protein, 37 aa, Artificial Sequence
  ChTx-L14
QFTNVSCTTSKECLSVCQRLHNTSRGKCMNKKCRCYS

SEQ ID NO: 1371 - protein, 37 aa, Artificial Sequence
  ChTx-A14
QFTNVSCTTSKECASVCQRLHNTSRGKCMNKKCRCYS

SEQ ID NO: 1372 - protein, 37 aa, Artificial Sequence
  ChTx-A15
QFTNVSCTTSKECWAVCQRLHNTSRGKCMNKKCRCYS

SEQ ID NO: 1373 - protein, 37 aa, Artificial Sequence
  ChTx-P15
QFTNVSCTTSKECWPVCQRLHNTSRGKCMNKKCRCYS

SEQ ID NO: 1374 - protein, 37 aa, Artificial Sequence
  ChTx-A16
QFTNVSCTTSKECWSACQRLHNTSRGKCMNKKCRCYS

SEQ ID NO: 1375 - protein, 37 aa, Artificial Sequence
  ChTx-P16
QFTNVSCTTSKECWSPCQRLHNTSRGKCMNKKCRCYS

SEQ ID NO: 1376 - protein, 37 aa, Artificial Sequence
  ChTx-A25
QFTNVSCTTSKECWSVCQRLHNTSAGKCMNKKCRCYS

SEQ ID NO: 1377 - protein, 37 aa, Artificial Sequence
  ChTx-A6
QFTNVACTTSKECWSVCQRLHNTSRGKCMNKKCRCYS

SEQ ID NO: 1378 - protein, 37 aa, Artificial Sequence
  ChTx-K6
QFTNVKCTTSKECWSVCQRLHNTSRGKCMNKKCRCYS

SEQ ID NO: 1379 - protein, 37 aa, Artificial Sequence
  ChTx-A10
QFTNVSCTTAKECWSVCQRLHNTSRGKCMNKKCRCYS

SEQ ID NO: 1380 - protein, 37 aa, Artificial Sequence
  ChTx-P10
QFTNVSCTTPKECWSVCQRLHNTSRGKCMNKKCRCYS

SEQ ID NO: 1381 - protein, 37 aa, Artificial Sequence
  ChTx-A12
QFTNVSCTTSKACWSVCQRLHNTSRGKCMNKKCRCYS

SEQ ID NO: 1382 - protein, 37 aa, Artificial Sequence
  ChTx-Q12
QFTNVSCTTSKQCWSVCQRLHNTSRGKCMNKKCRCYS

SEQ ID NO: 1383 - protein, 37 aa, Artificial Sequence
  ChTx-A1
AFTNVSCTTSKECWSVCQRLHNTSRGKCMNKKCRCYS

SEQ ID NO: 1384 - protein, 37 aa, Artificial Sequence
  ChTx-T1
TFTNVSCTTSKECWSVCQRLHNTSRGKCMNKKCRCYS

SEQ ID NO: 1385 - protein, 37 aa, Artificial Sequence
  ChTx-A2
QATNVSCTTSKECWSVCQRLHNTSRGKCMNKKCRCYS

SEQ ID NO: 1386 - protein, 37 aa, Artificial Sequence
  ChTx-I2
QITNVSCTTSKECWSVCQRLHNTSRGKCMNKKCRCYS

SEQ ID NO: 1387 - protein, 37 aa, Artificial Sequence
  ChTx-A3
QFANVSCTTSKECWSVCQRLHNTSRGKCMNKKCRCYS

SEQ ID NO: 1388 - protein, 37 aa, Artificial Sequence
  ChTx-I3
QFINVSCTTSKECWSVCQRLHNTSRGKCMNKKCRCYS

SEQ ID NO: 1389 - protein, 38 aa, Artificial Sequence
  ChTx-MgTx
TIINVKCTSPKQCLPPCKAQFGTSRGKCMNKKCRCYSP

SEQ ID NO: 1390 - protein, 38 aa, Artificial Sequence
  ChTx-MgTx-b
TIINVSCTSPKQCLPPCKAQFGTSRGKCMNKKCRCYSP

What is claimed is:

1. A composition of matter of the formula $(X^1)_a-(F^1)_d-(X^2)_b-(F^2)_e-(X^3)_c$ or multimers thereof, wherein:
$F^1$ and $F^2$ are half-life extending moieties, and d and e are each independently 0 or 1, provided that at least one of d and e is 1;
$X^1$, $X^2$, and $X^3$ are each independently $-(L)_f-P-(L)_g-$, and f and g are each independently 0 or 1;
P is a ShK peptide analog of no more than about 80 amino acid residues in length, comprising the amino acid sequence of SEQ ID NO: 914, SEQ ID NO: 915, SEQ ID NO: 916, or SEQ ID NO: 917, and comprising at least two intrapeptide disulfide bonds;
L is a linker; and
a, b, and c are each independently 0 or 1, provided that at least one of a, b and c is 1;
or a physiologically acceptable salt thereof.

2. The composition of matter of claim 1 of the formula $P-(L)_g-F^1$.

3. The composition of matter of claim 1 of the formula $F^1-(L)_f-P$.

4. The composition of matter of claim 1 of the formula $P-(L)_g-F^1-(L)_f-P$.

5. The composition of matter of claim 1 of the formula $F^1-(L)_f-P-(L)_g-F^2$.

6. The composition of matter of claim 1 of the formula $F^1-(L)_f-P-(L)_g-F^2-(L)_f-P$.

7. The composition of matter of claim 1 of the formula $F^1-F^2-(L)_f-P$

8. The composition of matter of claim 1 of the formula $P-(L)_g-F^1-F^2$.

9. The composition of matter of claim 1 of the formula $P-(L)_g-F^1-F^2-(L)_f-P$.

10. The composition of matter of claim 1, wherein $F^1$ or $F^2$, or both is a copolymer of ethylene glycol, a polypropylene glycol, a copolymer of propylene glycol, a carboxymethylcellulose, a polyvinyl pyrrolidone, a poly-1,3-dioxolane, a poly-1,3,6-trioxane, an ethylene/maleic anhydride copolymer, a polyaminoacid, a dextran n-vinyl pyrrolidone, a poly n-vinyl pyrrolidone, a propylene glycol homopolymer, a propylene oxide polymer, an ethylene oxide polymer, a polyoxyethylated polyol, a polyvinyl alcohol, a linear or branched glycosylated chain, a polyacetal, a long chain fatty acid, a long chain hydrophobic aliphatic group, an immunoglobulin $F_c$ domain or portion thereof, a CH2 domain of Fc, an Fc domain loop, an albumin, an albumin-binding protein, a transthyretin, a thyroxine-binding globulin, or a ligand that has an affinity for a long half-life serum protein, said ligand being selected from the group consisting of peptide ligands and small molecule ligands; or a combination of any of these members.

11. The composition of matter of claim 1 wherein $F^1$ or $F^2$, or both, comprises a human IgG Fc domain or a portion thereof.

12. The composition of matter of claim 11, wherein the human IgG. Fc domain comprises a human IgG1 Fc domain.

13. The composition of matter of claim 11, wherein the human IgG Fc domain comprises a human IgG2 Fc domain.

14. The composition of matter of claim 1, wherein $F^1$ and $F^2$ are different half-life extending moieties.

15. The composition of matter of claim 1, wherein $F^1$ or $F^2$, or both, comprises a sequence selected from the group consisting of SEQ ID NOS: 2, 4, 70, 71, 72, 74, 75, 76, 1340 through 1342, and 1359 through 1363 as set forth in (FIGS. 3, 4, 11A-C, 12A-C, and 12E-F).

16. The composition of matter of claim 1, wherein $F^1$ or $F^2$, or both, comprises a human serum albumin protein domain.

17. The composition of matter of claim 1, wherein F or $F^2$, or both, comprises a transthyretin protein domain.

18. The composition of matter of claim 1, wherein $F^1$ or $F^2$, or both, comprises a biologically suitable polymer or copolymer.

19. The composition of matter of claim 18, wherein the biologically suitable polymer is polyethylene glycol (PEG) of molecular mass about 1,000 Da to about 100,000 Da.

20. The composition of matter of claim 19, wherein the PEG is selected from the group consisting of 5 kD and 20 kD PEG.

21. The composition of matter of any of claim 5, 6, 8, or 9, wherein $F^1$ is an human IgG Fc domain or HSA, and $F^2$ is PEG.

22. The composition of matter of any of claim 5, 6, 7 or 9, wherein $F^2$ is an human IgG Fc domain or HSA and $F^1$ is PEG.

23. The composition of matter of claim 1, further comprising one or more PEG moieties conjugated to a non-PEG $F^1$ or non-PEG $F^2$, or to P, or to any combination of any of these.

24. The composition of matter of claim 1, in which the toxin peptide is inserted into a human IgG1 Fc domain loop.

25. A composition of matter, comprising a ShK peptide analog that comprises an amino acid sequence selected from the group consisting of SEQ ID NOS: 914 through 917 as set forth in Table 2, or a physiologically acceptable salt thereof.

26. A pharmaceutical composition, comprising the composition of claim 1 or claim 25; and a pharmaceutically acceptable carrier.

27. The composition of matter of claim 1, wherein any f or any g is 1, and L is a peptide linker comprising an amino acid sequence selected from the group consisting of SEQ ID NOS: 79, 84, and 637 through 656.

28. The composition of matter of claim 1 or claim 25, comprising a ShK peptide analog that comprises the amino acid sequence of SEQ ID NO: 914.

29. The composition of matter of claim 1 or claim 25, comprising a ShK peptide analog that comprises the amino acid sequence of SEQ ID NO: 915.

30. The composition of matter of claim 1 or claim 25, comprising a ShK peptide analog that comprises the amino acid sequence of SEQ ID NO: 916.

31. The composition of matter of claim 1 or claim 25, comprising a ShK peptide analog that comprises the amino acid sequence of SEQ ID NO: 917.

* * * * *

UNITED STATES PATENT AND TRADEMARK OFFICE
CERTIFICATE OF CORRECTION

PATENT NO.        : 7,833,979 B2
APPLICATION NO.   : 11/406454
DATED             : November 16, 2010
INVENTOR(S)       : Sullivan et al.

It is certified that error appears in the above-identified patent and that said Letters Patent is hereby corrected as shown below:

Column 215, line 40, the letters: "a, d, b, e, and c" in the formula should be subscript characters:

$(X^1)a\text{-}(F^1)d\text{-}(X^2)b\text{-}(F^2)e\text{-}(X^3)c$ to $(X^1)_a\text{-}(F^1)_d\text{-}(X^2)_b\text{-}(F^2)_e\text{-}(X^3)_c$ Column 215, line 46, change: "9" to subscript character "$_g$".

Column 216, line 38, add a "." to the end of claim 7, after the letter "P".

Column 216, line 46, add a "," after the word "both".

Column 216, line 67, delete the "." after "IgG" before "Fc".

Column 217, lines 8-9, delete the "(" before the word "FIGS." in line 8, and delete the ")" after the letter "F" in line 9.

Column 217, line 12, add a "$^1$" after the letter "F" (i.e., $F^1$).

Signed and Sealed this
Twenty-ninth Day of March, 2011

David J. Kappos
*Director of the United States Patent and Trademark Office*